United States Patent 10,240,205 (METHODS FOR ASSESSING RISK OF DEVELOPING A VIRAL DISEASE USING A GENETIC TEST) - sequence listing, part 18

SEQ ID NO: 1873 - DNA, 74283 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaagttttcaaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtctgctttagtagccagaatggaaaagcttattaattgccatctacattttttggtgatgatgacagttatatatatatatatatatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctctttgccctgtttaattttgagctctgacctttttgaattctgaattctgactcagcgctccagcttgatctgtcccttgagttaggagaacagtatggcactttttcaatttagtgacagtatttgctgctgtagcaaattgtttgaatgcagactagaatctcctggcctcaaagttcaccactcacctctaggtgcttataggccaagcctggggcaggaagctaaaaaaagacctttcaagcctccgtggaaaggaagcatagagtagtgttgaaaaacagactctggaactagactgcctggactcaaatctagctctgcgaccaactagttatatagccttggacaagttatttaacttctgcacctcattttccttaaccataaataataatagtacttacagagttgctgtgaggattacatgaggtaatttatgtaaagggcttagaactgtgcctagaatctaacaagtgatatacaaatgttatgattatttactgaattttactatatgcctaactttgtgctagatgggatggataagaaagaagacaggtagttgaattcttaccatttaatgagtggttactatgtactatttaccataagggatagaaataaatgaagggatgatacaactgctgccttcaaagatctcctatctcctatttaattggggatttagggctaattcacttaaaaacggcttgagaaaaatatatactttgcattgcattttctacaactttttgaggagaaagggtttactgggacatgaacagggccttaaagggtgtgtacacttgggagcagtggccgttctgggtgggaaagtgatgtgtttttggtatgtgggtgtaaaccaatggccctagaccaatgctctcttgaaagttactttatctgaagtgaagggaggcttgagctgctgactgattcaaggggagccacagatataagcatagatgaagctactctttctagggtaatttggatccaacaatcctttcttaattggcaaacaagggcctgtgggggagaccatacctttggttttccagaattgggcaaattaatttttttttttttgagatggagtctagctctgttgcccaggctggagtgcaatggtgcaatcttggctcactgcaacctccgcctcctgggttcaagcgattctcgttcctcagcctcccaaatagctgggattacaggcatgcgccaccacgcccagccaatttttgtatttttagtagagatggggtttcaccatgttggccaggctggtcttgaacttctgacctcaggtgatccacccgcctcagcctcccaaagtggtgggattacaggtgtgagccaccacgcccagcctgggcaaattaatttttaaaaatgttgcttttgttgcctaagtaggtatgtgagagggtcttttcttcatgcttacacatgaactaaaccaaagaatagagcttggcaataactttatgtcagcagcctagaaacagcttttaattctctcattgactttgctataaaatcaggtatttgggaaagggtggagatggcagggaggatttctcagtgtgtggttgttagaggtggaggagtatgacgttttctggccagggcacagctgcagcatctgggtcttgaatttggagaaaaggccttttgggcgactttcaaagcacagccctttgtctgtgcctaatgacacagataccagatctgatgctcctttcaatcggcttgttgtggcataaggtaagtgttgacatagctcttaggccactaatatggcaaatggctctgtgcttgcttagtagaactgttttgccagttatcttctgtgattggtgacttcgaatattgaagtttcttcccattcctggcaacccttctaccttgtgggaatttgatagatactttgtgcatccagggtagtgatcagggcctaatgagagaagagttgagatatgacaatttggttgtacaaaacaagatataatcctgaaaatttttttcctgggtatatatttgggaagtgactggggccaaggcctaggagggggaacaaggcatacctgtcaggcttgatcagtatttctttccctctctttagccttggcctccattaaatacctgagaaggatcaagtcttatttttctcaagttgtgtgtttagataaggttcctgatcttactttcgtgatctaatctgccttccctccaacccatgatccatttccttttttttcttttcttttttttttgagacggagtcttgctctgttgcccaggctggagtgcagtggcatgactttggctcactgcaacctccatctcctgggttcaagagattctcctgcctcagccacccaagtagctgggactacaggtgtgcgccgccacgcccggctaatttttatattttttttagtagagatgaggtttcaccatgttggccaggctggtcttgaactcctgacctcgggtgatctgcctgcttcagcctcccaaagtgctgggattacaagcgtgaggcactgcgcctggctgatccatttattttttcagattctcagcctggatgtttgatgaagctcaccaagagcctcttttatctgttgtaatttttaactgaggttgactaatctatggtatagagttggagggtgagggtcaaggtaacagtcaatctgggcatcattagttaagtcgtacaaatctttgctattttcaagggttttaagtgagctaaactcctctccaaacatccttgtagatacttgtgggagactgactaattcctttacaaagaagaaaagtcacataacttctttgccttttaattttctttttctccaacatgaaaatatcagcaatattagaaagaggcacatggagtttgcgtgtggtggctcatgcctgtaatcccagcactttgagaggctgaggcaggtggatcatttgaggtcaggaatttgagaccagcctggccaatatggtgaaaccttgtctctactaaaaatagaaaaaatagccgggcgtgttggcgggagcctgtaatcccagctacttgggaggctgaggcaggagaatcacttgaacctgggaggtggaggttacagtgagctgagatcacgccattgcactccagcctgggtgacaaagcaagactctgtctaaaaaaaaagaaaaaaaaaaagaaatatgtaaatggaaaagaacaaacccccctcccaggttccttattccccttggtgcctgggccattgtagatctagcatatgcttggtggggacatctgccatttgctttagggttacactacatctttctactttgagtgcttgaagagttgctccagcagggcctgatgtgggcctggtgaaaatctagcctagttgcctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtctgccttatttggctattttctcccccctcaagttactccctctccttgccaccccacctcaactagtcctctgttctcctttagtacagggaatgccttcttcaagtttatacaataccacctgcaaacttcttttcttcttgtttagagtcctaatataggggaggagtggggaaggagagaggaagatgggagagctctggaatgactgtgatttctccaccctgctttcttatctccctttatcctcttggcactgcctggtcactcctctacagcttcttacctagatctctgacagcctaggagtggtctcgattggcctaaagaggttcagagtgtgggggtgggatggggctagggctttcagcatttgaaactatttctttggagcaggtaaagccttccagttggtaagtctagttctttaagtatgcctgttgtatgcctagccttctcacttggctttcctgggtgggctgagtctaagttccctctacctccccttcccagtcctgagctgtctaactttaggttagaagagctgagcttttgacacttacagcttggggcacttgtctgggtgtctttaaaaataccttttagtaaaaaatggtacaatggaaagaagagtgagatatttggtttttaatctctgcctgtgtgaccttgggcaagtcacttttatgaggcttaattttcttatctacaaaatagagacattggctttttctgacattctgattatttgtgcccagtctttaagaggctaggaaaggggtcttggaaagcgtgtagcagagcagagtggtgacttttcggagaagcttccttttcccatttagaatggcattgagtgtgtcattttctcctctggctatcaacatgtaagcagccccctctatttcagtgagctctgctctgggatatactgaatctacctaccagagagctcactgtggagattctggcttggagagacaactgttgactacatgccttgggtggggtcttggagtccagcctgcagactacagttgctggctatttttggtcatctgtgactcaggaagaatagaagacccttggattggtcattgttccatcagggaaagggaagacaaagaaacaagctaaaactgaggacatatgagatttcacttcctttactccctcccccacaacatccctttttgtagggctatgaaattgcttttgactgagtcttaaattgctaagctccctttccccttcctctatctgaatcattgttgactatgttgcccttggacggggagagctaggtgatatgggcttgggtggagcaaaagggagaatttctagtcaggaagattgccacacacctagtgttgggctttcaactgatcctgtattttgtaaatatggtttcctttggtattagtcctggagatcaaaggagagggacttctgaattttctgtgagggcctacaaggctgatagggaataagcaagtttatgggaaaggtgtacccttcactggatctgtttttacccatcctctacttcttcctccttttcgtccttctcactgacactttatccagtgcttgcttgtgaaacaaggatcccacattggatctcagccacctaagagttggccatgaacataaaccttacctgctctgagccccctggagaaagcacaagaagtcttggcatctgttttccttcctttagaaacaagttccttgggcatccttgggcagtttaaccagagaagccttagttgggtagtgctgggcagtgctgttagggggaagattcttctccagcattgagctggaatggcctgtgggctatgcaggagcttgctgctggaagcagctgccttgctggaagcttctcattcttcctaggtacctcacatgggttgttagcgatgccagttgtaggtggtggatcaaaatggctgttggtttgggaaggtaggcaagcaggtggaggaagaaggaatgtagagtcaaatggaagaagagtggttctttttttatatttcccctttttttaaaactcagcatggcatatgacaaagtttagcaaatagagagagaaattgtgtataaattcatcattttaacatggcaataattatttgtatttcttgtcgtatctcatatatgtaccttagtttttggtggtgcaatcatagtgtacataaaaaagttctccttctttccccctacttaacacatcactaaaaacttagataaatgctatttaattttaagaaatgaacattctaatggccatgtaaaattctattcaaaggctatgccataatttaaaaccattctcctttgggggagcatttagattactcccagcatttgctagtatagatacattcccatgaatgtgaaaagagaaaattgaaacctcttagcatagcatatagggaggtccctttggtacctcaccccattctagcttcctctcccaactcagctcccatttattcccacatgtatgctatgtggtagctttgtgggcccaaggtttcccaagtccaagtaagctatacccgtcctttttctttttttcatccagctttttcaggttgaatttgttttgttttgttttgtttttttgagacagagtctcactctgttgcccaggctggagtgcagtggtccaatcttggctcactgcaacctccacctcctgggttcaagcgattcttgtgcctcagcctccctagcagctgggattacagggatgtgccaccaaacctggctaatttttgtatttttttagtagagacagggttttaccatgttggccaggctggtcttgaactcctggcctaaagtgatccacccacctcagcctcccaaagtgctgggattacaggtatgagccactgcacctggccatgattttttttttaactgtggaaagcaatgccatacctcttctttctgctttagcctatgttctttccttcagcttgaaatttcaggtgcctcttcttcatctcccccccactccatgtcacttccattggaaactttctttattactcccagatagtattgtactatcttctatgtgcccactgtactttgtaagaacttctgttatgttatttaccatgcagaattgcagccatctgggctcctaggcttgctctttcattaaacgtgtgcatttggaagcttctagctcttcctgtctcaagaaggggccattctccaggtggaggtggttaggaatggacaaacctttgaggagcatttggtcagtaatatacatggtgagggagaagcagtagcaatgaatgcaggggatccaacagtgttggatgagcacctggtagggcatactaaccactagtaatagagaaaatacaccttggagaagggacaggtgtattagcacctatggggaagagaggcctgagtgtaagtacagagaaagcctagctggccttgagtcaccagtgcaaattctgaaaccattccagattttagttccccatctgtggaatggaaagagtaatagcaacctactttttagggttatgctgaggattcattcagtgcactaatgcatctgcaagtggtctgtgaggtgtgaggcacaaaggaaggaaggtaggcccaggacactccagtatgtttgttccagttggccttttaaagttctgtgctatatgtgattccaatcaagcctctgaacccagaatgccagatgctacagtttctctgaaccccacataggtgcccctacagccagttttttattttttttttaagtaggaagtatgcagggaagtaccatctcctcactcatttgagcagcctgactccaactggccctagcacagccctactcaagaatgaccacaagtgcctggggagggaggggccaccatcaccttagctctttagtataaaataagtggtttagagtagagggtttcttaacatccctttagctataggtagaagtgtagaagctgcagtgaaactgagcacctttcaggtcttctggtctgaagcctgccatgtactgtgggaaggacagatcttcatgtctgtcactaactgtatactctttagaggcctgcccatctcatctgtcttaggaaaacagttcatgaagaaccatctaagccaaattcaaggtctttgagtggagaatctcaattaattgctttttgttttcaccacatactacccatggcttcttttgttgtttttattgttgttgttgggacccttggcttcttgctgctgccttggccatttgcatacccccattccaccccaggactttatgttttgtaaggaagcaaattacctgagccagtggaagatctactggtcacctataaatcaacacgaagaagggacttgctcaaggtcatgtattgaggcagaagcagaaactggtattgaaggcaagactctcaggagtgtgttctttccattatgtcagtctagcccactagtgtgtaagcttcatgagaacagagatggtttctcaccacccattatatccccggtacccaacacaatgatgcctggcataaagtagattctcaacaaatatttattgaatagatatgttaatagctactattttcatgttggaactgtcttctttagattcctttagctagatctaccagatagccaaacaacaattccattgatccactggaaactacctaatgtggacccagctgggccctggcagaatggaacagggtagcaccggggaatgggaaggcattgtctctcttgtgcaccttggagagactgtttatctgtgagtggccagcatgttcatagccatttctgctcccttttcccatatcttcacataatacagtagtgttcgtgtcaagtgggaatattcaaatcaaaactttttgtggattctaacaggcagccatgcaaacatttctgtccacctttgtgaagtagcccaaagtttggctgtacagtacatatttgagacattactcaatttttaatttttttgtgtttgtgctgctcattatggcatggccagcaggcagggctgcattgcataatttaatcctgagaggtttgtgcacctgaggtttagggatttggttggcccctgtgctgaggcctaggaagagacaggcatagaccagggaggatagcaaggaagtcctggcgatcataatgttggggcatccagtggatatccactcttgctattgctactgttgccgccgccgccaccaccaccaccaccaccaccaccaccaccaccaccaccaccaccacccaggctgctttagggcccagagctgcttatctttgcagacttggtattttttggccaaggtagactaattttgggggcagtaggagatattttcctcccatccactcctgagaaaagggtagggccagcatttgagaggtgtaggtttatgcttactaggtaaggttgactgtcctaaaatagagagagcttctgaagttcacctagtctttaaaggacttttcccatctgtttttttagtcctgagccatataaggaaagttaacagacacaatctctgctgtgtggtggaacagatttaaataaatacagactttgttttacaattttggattaatttttcattatgaaactaaacatgtttgttgtaagaaatgaaacagcattgaaaaatataaagcctcctgtcttctgcccctgactgtattctccagagacaaccatcattaaccagttagttatgtgaacataaactcttttttttctttctttctttttcttttttttttttttttgagatggagtcttgctctgttgcccaggctggagtgcagtgatgcgatcttggctcactgcaacctccgcctcccaggttcaagtgattctcatgcctcagtctcccgagtagctggggttataggtgcctgccaccatgtccagctaattttttctatttttagtagaaatgtggtcttgccatgttggccagcctggtcttgaactcctgacctcaggtgatccacctgcctcggcctcccaaagtgcggggattacaggcatgagccactgcgcccagcccatagactcttttttcatgcatttgtatatatatgcctttaaatgcacagatagtacaaatccgtattgttctgcttttttaacttagtatgtgctggccatcttttaatgtcaaatccgattttaaagtctacaggggctcattaataagcaaatcagcaaataggtagaacactttttaaacattaaaatcttttttttcttttttttttttgaggcagagttttgctctttttgcccaggctggagtgcaatggcgcgatctcggctcactgcaacctctgcctcccgggttcaagctattctcctgcctcggcctcccgagtaactgggattacaggcacatgccaccacgccagactaattttgtatttttagtagagatggggtttcatcatgttggtcaggctggtctcgaactcctgacctccagtaatccacccgcctcggcctcccaaagtgctgggattataagcgtaagccactgtgcctggccaaaaaagcttttttatatagagacagcgtctcactctgttacccaggccggagtgcagtggtgtgatcatagcacactgtaacctccaactcttgggcttaagcagtcctcctgtctcagccccctgagtggctaagactacaggtgcattctaccatgcccagttatttttctattttttgtatggacagggtactagctatgttgcccaggctagtcttgagctcctgggctcaagcaatcctatcacctcagcctcccaaagtgttgggattaaaggcgtgagccaccaatgcctggatgaattggtggaacacttaaaatctacacaaataaaggggccatactcttcattaagtggaaaataaagaagttgtaatgaggatttgtctgtctgagagggaaggttttctgaagatgtgatatgtgaacccttctgttgcgatgaaagatgatggtagctgctcccctttctatgctcagtaggccccacctatagagattgctttagatcctgtgtctaaatgagctcagtggagtgattagtggtaggataaacttattttctatgcttagcatggtccccttcctgttttgtggttttgccagcttggggtggtttgattccagacagtacctgactgagaatcctgcacctcagaagacctctggctgttggagctgtctgaggtgaaggaaagaaactttgtgagtgtacatatgtgtgtgtttgtgataggcacatgcttttccaatgttctccacagaagagcagtggaggctggtccgatggtagtgggttaccgatggtactgggttgtcagaacttgttaacattagcatcactgaagtttttgtttttgtttttgtttttttgagacagagtcttgctctgtcacccaggttggagtgcagtggtatgatcttggctcacggtagcctccaccttccaggttcaagcagttctcatgcctcagcctcccaagtataggcgtgcaccactgtgcctggccaattttaatatttttagtagagacaggtttttgccgtgttggccaggctggtcttgaactgttggcttcaagcaatcttcctgccttgacctcccaaagtgttgggattgcaggcgtgagccaccacgcctcagccactgaagtgggtgtacaaccccccactgctaaatttgactggcttaaaaacaaacaaacaaacaaacaaagaagagctgtggaagggcctgtcaattatcagagaagctagattagaatccccttcctaacaacatacacatcaggaatcttgtccaggtggtaggaaagtggaattttgcagagcactcagctgtaggtgagccaccagttgaataattgaggaagatagtgatttgtgaaatacaaatattttgaaagaaaaattctagcctagtggtcactggtcctggtcttagaagctttctaacttgagagtattgattatgttgaaggaaccaggccactagaggagaagcagaattaccagaaatgctggctctattctgcccactcatggcaggccccacctttctcttgcctttttattcccagacttccacagttggtggggcagagttctgcttgcccagcctttaatcctggaacctctgctaccagaggttgaccctgactgggctaggcccacaggccactgcaggcattattcccttccccttcagacaaacaggaagctgcctgcacactcttagtgattggcactttcaggagctttgtgaggcagggagtttgagatcaggttccaaaaggaaaaggaaatgacattttaaataattttttgggctacttgagaaggtgtggatccaaagtatctccaggcatttattgtaggccaggcttgcaggaatatctgtgtttccatacttacttgctgtttgaccttggagaaatcccttaacctccctgagcctccacttctcccgttggtaaagtgggaatgattatgtgttaacctcagaattggtgggaaacttggataagttagcagtggaaggctctgaaatgttagctcgtagaaaatcaagtgttcaggattcaggtgctcagagaagtttaaatcatgttttaatagtctctgttgacaaaagcagtagagtatatcagtagatgaaagactttcagctcaccactaagaatagttatgatccttaaacgggtgagcctcagttatcagaaaatgttcacttctgtgatacagctcatttatagaccatttaggaccaatgaggcattgccatataatcatctctcaaccatccataataaaactctcttctcggccaggcgtggtggctcatgcctataatcccagcactttgggaggctgaggcgggtggatcacgaggtcaggagtttgagaccagcctgaccaacatggtgaaaccccgtctctactaaaaatactaaaaaaattagctgggtgtggtggcgagtgcttataatcccagctactcaggaggctgaggcaggagaatcgcttgaatctgggaggcagaggttgcagtgagctgagattgagccactgcactccagcctgggtgacagagcgagactctctcaaaaaacaaacaaacacacaaacaaacaaacaaaaaaatcccctctcttctcagctacctgtggactgcctgttctaaataatgtgagctcagggaatacaggctcttctgataatccaaataacacataattagttatgcaaacgtgtcctaaaagtttccagggtgaagtggttaggttgctgttgctgagtaatccatagagtattactcttatgttgatgtgggtaactgaccttaactataaggaaaatggtgaactttgcactctggagcaaggaaagtgataggcttctacttctcaggtcatttgtgccttcactgaccatccctccagctgtgaactcaggtagaggcagcatatttatgagaatcggattagaaaggaggcaatccttcaaagatcggaggttgagaagacatgtttgagtgtgccctgcatggacttttattccagggagagtcgagtagttctcccttcatcacactctactgagattgtcctttggcaagaagaaccaagcttaaagaaaatcttaaaagagccattaggaacctcttggggcaagttcttctggaacctctagctgcttaacatcccagaaaaagaaattctagggttaggaagctggaaaggatttataattttaggggatagctgcccattttccaaatagttttctgtttaaaatagccaagtcagatgcgaattgaaggaatctcttgacaggttggctggcattgccctgtaatttttttccagtgtccaagtaatgataattctctatatttgtaacaagtttcatagttgtaaaactcttttttattgttattactatgtcatttgatattcatcaactctctacagttggcaggttaggaattattatcttttttaaaattattttttaaaatagagacagggtttcactgtgttggccagcctagtcgcgaactcctgggctcaagagatccgcccacttcggcctctcaaagtgctgggattacaggtgtgagccaacacacccagccaggaattattatctttacttttacataagggaaaactggggctcatagactttaagtggctgcaaaaattactcagctaatgagtaatggagacaaggcttgattgggagacagaagactttggttttcgactatgcacggggtggagtgtgggaagggaaggcagtgttgtttcataaaggcctggacttaagctctggtcatggttaggtcagagttctgaagctagaaaggaagtttcagctttaaacatttggcccttcccccgttccagtggttgcccaacctcttttcagtctctcttctaaatattgtaagtcaagactaatgtttagagagagagcacttgggggctgtgtggggatggccacctgttatatttgtgtcctgcctacttggggcctggcctgactctggttttgcaactggcttcctgtgtaacccattcttggtagtgtcagaccactgccttcaaggctaattgtgctttccacctggttgagccaataacttattttgttttgccatgctcctggacatatgggagttgcttattagtaggtgagaattgtttgggggctgcttagacctagctaatgtagagtcttgtttgtaccttggtgggagcaagagcatcaatccaactttttgttgagaggaagaggtattggagaatcatggaaaaggcactcttttttagttgaagagctgttgtttatgctgggccttgctgttagctttccagagcaatcttgaccaagtccttgctcgtttttgggccatagcctgttccacaagaggttggtttggctaacctctgagggctatttcctgctctgaaactctgatttattcagaaatgttatactcccctaacaatggaggctggtctgccctcccatgggtacgggaatggtggcacacatctcagaaatggttttgttctgtgcggaactgagccaaatggacaactctaccagctccaaaaagttggaagtggtcagctgtgtctgaattttgtaagggagcataactgggtggaggggtgaacaggcatcattagaggccggatgtggatgaggagggaagaagtgccctggagaggtagttcatagagaacccaccagaaacaggtgataagctgacatcatgaggtagatggtttatcccagtctgtggccaggtagttcctggtcacaagcagttggtacgccctcaggaatgtgataccatcacatgggaatgtgtcactagagcagccaaaaggctgtggatgcaggaagagcagctctctcttgtcaccattccctctgtgaagggtgggagattcttaaaattgggccatagagaccatatgtggcaaatgaaaaaaacaattcacaatggcagataggactggtcctttagagaaaggaaaagttgtaatgcttgcctgatgtcaaagcatgtggggttggatttgctagttccaatacattttaattttttttcttgtggacttgaagcaaggtttggaaaaagggggaaatttgaactcatgacctttggaaaccagaatgaagcttaatgttgactgttagagctgcccttcttatagtagggggctgagttttgcatggagccatctaggctccctgccttctgatctaccttggccagggtgtacctggggaagtccagcttgcctgtgtaattgatcttgaccagtttgtaggagcacgtgtagactctgattaattggtttgggttaaggctttgggaatcaatattttctgagcactcccacagggaattctaacattgggcaaaggttgattactgcatctctaatagaagcctctccttgctacatgtgacaaaactgaaccagagaaaggggagggaggcctgtgcccatgtcaatatggcatggatacagctgatctgagcactgagctaatgctttttccagggctctttggactcttctaacagttcaattggacatcctctaaacttggtcagaggtccagaaggagatagtagttatggcccccaacccaaaagtgctggaggaaggggtggggttaactaattgcacccaagggaggtgagcagccctttttagagagtgagttcaccgtctgggcgtgagcagaccagtggttgggggaaaggggaaggatagaacaggataggaggtgagtaatgctgtgggcatcaagacattcagttagtgggaacattatagggagctggtgagctcaaggacctggtgacttcactcctcagatccatgtggacttgcagggctggagccctgtctcagtgtccaagacgtgtgtcttgtgcctgggaactgaggactgcttgttctctgcttcctgcttcagctggatggcctttacgcttgattagggagtgagcccagccatagagcagcctctccttggccccagcccctactgctactatcctttcagagtggatcaagctctcgcgcatattggggcacactgtatcacagtgtggtctttgattatttttccactgttttacatgtagtatcccgagtagagaataagctccttctatggtaggaaagggggctttgttccaagtccttcctaggggcatgggaaggtgcttaatggagagaagcaagcagcatgagtaggacactttgggtttcttttctctcgccagtatcaaaaggaacttttcttaggagagaaaggtaactgggagctttagggtggatatagtacacacttcattctctggggtccaagaattatgtctttttcctactaggtggggaaccccttgaagtagtacttggcatagtctctgtattcccagtgcagagtaaaataccccacactttgcaggggttcaatagctgctgaattggtttaagggcattttttgtcttatcctctcccttgagtcagattagattccccagaagccccctatctcctggctgaagactatggaagctaacaggggaggaaaggaagggctgcatccacagttggctgtctggcacctcttggatccagaaatccacctataattcttagcagtagttaacttttcaggtgtatatactttcacatgtagatgttttttatttctttttgtttcttttcctttttttttgagatggagttttgctcttgttgcccaggctggagtgcaatggtgcaatctcgacttactgcaactttcgcctcctgggttcaagtgattatgctgcctcagcctcccgagtagctgggattccaggtgcccgcctccacgcctggttaattttttgtatttttagtagagatggggtttcaccatgttggccaggctggtcttgaacacctggccttaggtaatccacccacctcagcctcccaaagtgttgggattacaggcgtgagccactgttcccggctcttttctttttctagaggaggaacaattgtgaagagccagggtgggaggttagaaggtaggcactcctgaatggttgtttcttcccaccacttttgagagaagggccaagcagatcatgaacatcctagacttagtccagaggagaaaggccttagtgtagtgttggccactaatggaggtcattagccgtggagctctgtggtggccttctttcattcttagcctctcactcccattgagtttggcatccttagcttgatttccttttattctccaaaccttttctgagggaatagggagagaagcaaggcacacatgttcctttgcttcttgagcccttaattggccagctgggagggatccccttcttgcttctttcttcttcatgcatgcctgttgctctctaaggtcagggatttgagccagaggcctgggagtcaggtactttatggctcagcccctggcctggggcctcctattgtggggatcagcttggcccagggccttcctagtatgagaatggaatgagcttttgtggaagatggttagtggtctaagcttattatctattttttctgccagtgcctttgcataggaagggagtaggctgctatgtatgatcaattggtatgtgggccagttatctttggctaactttcagataaaacctttgctgtccatcttttttggaaagtagaatgtgaaaagagatatttatccaggtttgaggccttgcagatagtcagtggagttatcagtatttggttaagtctaggaattggtgaacttgcctgttggaccagtttttgtatgtatcataaaaataagttttaccattttaaaaacattttttgtttgtttgttggtttttgtttgttttgttttgttttcagacggagttttgctcttgttgcccaggctggagtgcagtggcatgatctcggctcactgcaacttctgcctcccaggttcaagcgattctcctgcctcagcctcctgaatagctgggattacaggcgcccaccaccactcctagctaatttttgtatttttagtagatacgaggtttcgccatattggctaggctggtctcgaactcctggcctcaggtgatcctcccacctcggccagcgttgtttttttaaaaaagaaaaaagaatatgtaaccaagactataagtggcttacagagacagtttgccaatctctgctagtctgtgctttagactgccaatttattgtatacctatttcttatatactcatggcttctttatagtcacctctttcctgatccagacacactgcaggcctttgaatcctgcttcttgtagccaatcataaataccttccatgttggttactaactaaccaaaccattgtgtctccttccatgtatacatggggtctgtggtcacctagggttagaattaaaattgtacttttcaaaaaatcagctcctgggttcattgattttttgaagggttttttgtgtctctatctccttcagttctgcactgatcttagttatttcttgccttctgctagcttttgatgtgtttgctcttgcttctctagttcttttaattgtgatgttagggtgtcaattttagatctttcctgctttctcttgtgggcatttagtgctataaatttccctttagggactaaagaatatttatgagtagtcaatgagtgaggttggcttaaatggttttcaggtgataattaatggtgagcatcctaagtagagttgcctcaggtcttcctgcgatttttttggggggcctagagtctcatcaacattgctcaagttgattcaagagaaaggagggtggtagttataagataaatgacagaccaaatattagaatcattttaaccattatttattgctgcatgactttgggtaatgtatttaatgtctctcaaccttagtttccccatctttaaaatggaggatagtgggccgggcgcagtggctcacgcctgtaatcccagcactttgggaggccgaggcgggcagatcacgaggtcaggagatccagaccatcctggctaacacggtgaaaccccgtctctactaaaaatacaaaaaattagccgggcatggtggcatgtgcctgtattcccagctattcgggaggctgaggcaggagaatcgcttgaacccaggaggcggaggttgcagtgagccaagatcgcaccactgcactacagcctgggtgacagagcaagactccatctcaaacaaacacacaaacaaaaaacaaaaaaaaaaaacaaaacggaggatagtactgatacctacttcactgagatttatgagagttaaaagagctcaagagtatgagtatatctaggagagtacctggcatattgaaagtgcttgataaatggctgagttccctaagtcttttccatcatactttgccctctttaaggatttgagatcaaataattttagaaccctgaagtctgcttttaatttgtgagtgtgcctcctatactacattatctctttaagatttttttttttttttgagacggagtctctgtctgtcgcccaggctggaatgcagtggcacgatctccgctcactgcagcctttgcctcccaggttccagcgattccctgtctcagcctcccgaggagctgggactagaggcatgcaccaccacgcccggctaatttttgtattttagtagagatggggtttcaccatgttgtccaggctagttctggaactcctggcctcaagtaatccacccgcctcagcctccaaaagtgctgggattacaggcgtgagccaccacgcccggcactctttacggttttgttttaatagatgaggaaactgatacttcaaacagtgatgccaatgactggcctagtttgtggtgaaacccatcgtgccttctgctgcaatctgttggagggaacggttgtctgagaatccatgtgggtgtatctatcactttgtaaagaggaactccagctctgggaagccttaaaagtcccaggatgagggagtagtagaaaaggagaagagggacatgagacccagggtagaaaggatggttatggggtgtgaagaatggaggatgtaggaaggagaaaatgattagaggaatccttacttaagaaggcaaaacagtttgtgaaatcaatggatctccacccctttgcagaagccaggcagccttggctggggcccacctcaggcccttgttatgctggtagctttcacttcttctttgtgtgtgtgtgtgtctgcgtgtgtgtgtgtgtgtgtgtgtgtgtgtggtggtggtggtggtggagtatagatgcagagggatcttagtttggttgcctttccaggtctatctgtaggtaggcaggttatccatgtgtattgaaagtatgttgtcgggccgggcgtgttggctcacgcctgtaatcccagcactttgggaggctgaggtgggtggataacctgaggtcaggagttcgagaccagcctgatcaacatggtgaaaccccgtctctactaaaaatacaaaattagccatgcgtggtggcacatgcctgtgatcccagctacttgggttgctgaggcatgagaatagcttgaacctgggaggtggaagttgcagttagccgagatcatgagatcgtgccattgcactccaggctgggctacaagacaaaactctgtctcaaaaaaaaaaaaaaaaaaaaaaaaaaacaaagaaagaaagtatgttgtcatgggctccctcaagtcctgaagagtgattcctctgaggtctgtgtgagctagggtggggagtgctcattaagctaagctggtgcctcagtggggctgtgggaacataatcagcttcttatctttattttatacattagtctatcttgcctggctttgtcttcagggatttctgtctctgattgtggcccatctcccccaaatctatgagctggcacctaatgccaaagtggtgggaagatctttaattcattttcttctgataaattctgggaagagggtcaggaagctgggaaaggagacactgatatttaacttcatgcctttgagagaaaggcatactttgtgtttcttacctctgtatccctgtacatgctgtctctctacccagaataccatgaggttccttttccctttaatctttttcttgtgacagtctcctttgtccttcaggagaggtcagctctatctcaagcaaccttctgccttctcacctccccttgtctcctcaccttccccattatggcctggatgcctcttgcttgtgtttccacagtccactttaattacctctatctctgcccttgctgtatagaatggtaatttctcatccatttatctgcatatttcctccatctgacaaaaaaatgccctcacgtgcttgctcattcacacacacacacacacacacacacacgaattatttcaaagcctgatccgatccatattgggtgtctgataaagtggtggtatgtagaacctgtatgtgtatacatatgtctgtgtcaatgatgtgggttctttctgaaacacctgaggtaggtaagaggtagccttacttgtttttccagatcttgctagaatagtagatttttagggtttgctttggattatggaacaatgtatgttgccttgaccattagggaggcttctgggtaatttccatagagattctggttggcctctttactgttgtctgaaaaaactagaccaaacattcggggctgggggtaggattcttattctctccaaagaactgatatgaatatgtgtgtggggggctagataggttcatgctcgctcacctcagcattgaggggtgtgaaggttatatgtttgtggtggtaggggtgctaaaaacccttgtattattgcaggataggttaaatagtttttactagtctcagtaaattgttagctgagcttgtggtttggagggaaagatgtggctttatcaactcgaaaaaacaaagccagcttttagagaagttacctcaagctacatagggaccaaaactaataagctggatgccatgtggtctcttatcttatccttgccaccaagagactcttccaaaacaatcatagatccatacagcccaagagcattctttgggctctctgaacctctgcttccaggaaggcggtcatacaaaaatgaaggctgtgagctaatggctgtaaacaaatacacttgcagcaggttatgaggccacctttcaaccttcagcacatccactggaggtaggtatttttgagactactctcaaaaaattttttcttaaggcctacgtgataaaccttgttccctaatggggatgagaattggattaggctgtaagattagcctaggggaacagcaggctgggtggggggttggggacatcctgcttaggggtagccagccaaagtcccccatacaagcccaaccaaggatcatgccacattgaaggtctgcacagtagtgaggcagtgctgtggaatgacatctgccttccaacttcttacgtgagtaaggaggctctccctgaatattcagatggatgttcagccacattctttgctatatttatagggtggggagggaagacaagggggagccagggagtccgagctgtttagagaggagagaaggaagtttcaacaatgggtaggttcaggctgtggttcctcctcactgccccttcctctttgagtttgtcaggggaccttcctatggcctgagatcattttctttttcaaagtggccaaagccactgtaggcacatttaaatcagggtgctttagcagaaataccaatgctggcatctaaaacccatgtgtagtgagacttgattgacatttgggacctttttaaaactgtaattttattgtatttttgcatttcctggtttgttaatcaaggaagaacattggcatgtcatcttccagtctccaaatgtaagttaaattgtcaatttgtgtttttccagaaaatttctttttccagaagtgctttgaatcatgatcatctatctgtaggcatggatcctccaatttagaagttgctcctagtgttacctagttacccttcctgttccattctgtgaaactgggagatttactgtagattattcagtctggtcagacagaaaactgcagctccctccccagtcaaccaaagcctcctctatggaggggaggtatggtaatgacattatctttccttaggcagccgcgtgttctctgagaacaggatgtggggagggctgggccccagtcacagggtatgggggtgggcaccggaaaatgggctggtggtaaggccatgaggattagtgcttgccttcttggctttgagaggcatgaagagctcctgtattcttgattgttcactcatgtgtacaccccaccctcgcacatggcatgtctgtgttcttaccctaagaaagactgtacctgagaaacaccttgtgtaagagccccagctgtttggcttgcagaaactcagtgaggtggagtgagtgggcccaggctgctcactgtaccaacccatgccttgtgattctttatgacagcctgtggcttcaggccacttttgctaagctttattggggagctgggccccagtagataatgggcagctttgctgctctttctcagggccccagttgtttccctccccacaaatggctccttagctgaggtgatttgcatgttcaacttcctttcaggccccatccttctcttctccctgccccccactgcttctgctggggacctgtggtgatgttctgcctggggtggggaaaagaggatgtagctagcttcctgtgcaaaagagggtggggcgccggccttcctgcctgtctgcccacccacccagtgcttgaggaattgcctgaagagttcagttcagagtcaccagagcctgaagggctttcttcagagtagagattgacctttgctcatgctggtctctctccacagttttctactgtgggaatagctggacacttttttcctgaaatcgcaatgctgaaaggacctttagaggccaactagaccaaccacttcacattacagatggggaaactgaagcccagaaagtcatataagtcctataaggaatcagtggcaaagctaggatgagtagaattctagaaggtcagacctagggctctctccctcccgtcaagctgctaatccagtgggttacaaactgtttggctgggctacctggtgagctacagcctcccttcaaccagaacagctctacttttacgtacttcatattttgaagttttgtgtgattttctgtttgggagattgaggaggcaggaagctgttagaaatgtaataaagtcaaaaccactgagcaaaacccagccattacagttgggaacactcagacctacagggggaagtaaatatccgaagtttactgggattggactcagagacccaatctctgaaccaccattcatggctggttgctccgagctaaagatgtggctccttctaccacaagggctgttcccaccctgtgttaccaatgctattctcctttcccaaagacagcctcttttgtagcatcctaagacagacctgaagtccagaggctgctcaatttcttggatgaaacaaatgataagccaggagcggtggctcacgcctgtaatcccagcactttgggaggccgaggcgggtggatcacgaggtcgggagatcgagaccatcctggctaacacagtgaaacaccgtctctactaaaaataaaaaaaaatagctgggtgtggtggtgggcgcctgtagtcccagctactcggaaggctgaggcaggagaatggcgtgaacccaggaggcggagcttgcagtgagccgagatggtgccactgcactccagcctgggcaacagagcgagaatctgtttcaaaaaaaaaaaaaaaaaaaaaaagacaaatgataataggcaagcctttggaaggacctttgtgtagccttaaataagataaacttggaaaggtaaagaacagaatactagtagttggggagatcagggttctagttctatttctttcacacttgagcatgttgctttttaccttactgaacctccatttctcccttctttaaaatggtacttgtctcgggcttgtctttttcttacagggtttaattcagtgagagaatgcatatgggcaagtatcttttaaattgtagagcactgtgcgcatggggctaggattattgttgtatacaagtgagccagagaccctggaagaatctgggttggataatggcattgcaggagaaaggaactaaaatttatgaaacatctactacatgccaggtaccaagccaggtgcttttctgtttgtaaaggataaaatgtcagccttgcaacactccggtgaggtaggcattattactcccattttacctgtaggaaaactgaggctttaagaggtctagggacttgtaatgttccagagactacctctagagcccagggtttctgtcaggtatttgtgaagagatcttaagaatgtcctatggtttctattggggttttctagcccactccctgcctcactccagcctctctcctctggtggggatgagactgtctcttgttggcttcatgtctcagtcctgaactctttatcctcagatttccttggagtgcactgggcacaattaggtgcccttgtttggcctttagctgatggggagccctttgggtcagccaccttttggctgatagtaaggatgtcctgctaccctggggtgctggtaaggagagccagggatttatagctagccagacagacttggctcttggtcaaggtcatgcagctagaaaatagcagttggttcctttctttgagactcagtttcctcattcataaaatgggtttaataatgcttaacttgcatgtgtctcttgtccagtgtgctggtaaatgtttaacaatcaactcttcggcaaatccatgatttttactgtttgccaattcccatggtataaatactcccaccatggctgatttcaggttaccaatatgcagtccttgatggaggagttgggaagagatgtgcatgatcagctctagtgcaagctggttctagtgcaccattgctagtcacacctattttagactcctaccctcaccctccaacatactcacatctgtatgcaaatgcagcatcctctcaaccatgcctcttcttttcctcaagttccaagagcatcaaggaaagagagagcttcatttaaggtctgctccttgcctgaaagttcttccaggaaagagtgaatgtggagtgtttaagacgcagagaactcaagagggctttgagtggggccctaattatagcattgtgatcatcatgctttggctgctgaagtatctgaactgtctgttttctcccactgtttgattcttagctagatgggaggatggttgaagatcctggacaatggtctgagggtctggtgcacttagcgttctgattgtaatttcaaagtctcctcctcttcctgcctgcagaccttactttgctgggtgctaacctcaaggttcctgtcatggggatctctgggccagaaagcattttggatgaccagagatccctggtcctgttctctcatttcaacagcatcaaggccatgtgttgtttctttgaacttttcagatggaaagaatcacctgaggcatttgttaaaatgctaattccccagcgtcttctctggagagtccatttcagtaagcttggggtggtgtccagaagtctggactttttgaccagtgccaaattcttatggtaagctaagtttgggatatacctcattaagcactgcacaacactcctgccatggtggcatcattatgcccacgttacaagttgaaatttaagagttcatggtttattattggtagacctggatcttgagatcaggttttcagaatacaaagctatgttcctcttactacagagacattactttagtgcacagtggtgtatgtgatggtgtgtagtgatgattttaggtagggaggagcagggataatccctgcactactttacaaatagggaggccaaggtgcagagggatttgagggcagtagcagaactgactgcatccttgcatccttgatcttttgtggatgtggaccgtattcaattggcttttttttttttttttgagacggagtcttcctctgtcgcctgtcgcccatgctgcaggacagtggtgcaatctcggctcactgcaacctctgcctcccgggttcaagcgattctccttcctcagcctcccaagtagctgggactacaagaatgcaccgctacacctggctaatttttgtatttttagtagagacggggtttcaccatgttggccaggctggtcttgaactcctggcctcaagtgatctgcccgccttggcctcccaaagtgttgggattacaggcgtgagccaccgcacccggcctttcagttgctctttacttgctgtgtttcccttctatcagacatccctctagtcatattaacaccatcccaggccaggcgtggtggctcacgcctgtaatcgcagcactttgggaggcaaaggcggtcgaatcacttaaggccaggagttcaagaccagcctggacaacagggtgaaaccccttctctactaaaaatacaaaaattagccagacatagtggtgggtgcctgtaattgcagctacttgggaggctgaagcaggggaattgcttgaacccgggagacgggggttgcagtgagccaagatcacgccattgcactccagcctgggtgacagagtgagactctgtctaaaacaaaacaaaacaaaacaaaacaaaaacagtttgtgatcttctggataccatctgagggagtttggaggtcccagtgggttgtgttgagggttgcagacttgtgtgtgttaatgggacataactggagaaaatggcaaggcagagtccagaataaggaaggaagatcaggcagcctttgaaaataataaggcagcataggtgctgtgttgtgctctgcctttccataggattctgcttcttggggaggaaatccccatctctctcaagagataaaatatttaaaataatgctggaatacatgtgtatttaactgttgtgcatggtttcacattgtcttgccaactagaaatgtaatcaccttttagttttccctgaaagtgagagtcctttatgctagaagggctctttagaggtcttcttgggcagcccctagccctctgtagtgaaacaggtttttgttttaaattattcctgacaggtaggatattcgtcataatatggctaaaaggggagggattagtaatcatcacattctacttatgatgtgtcaagtactttcatgtctattattattattatttttatttttattactgttcaattattttcttcctccagtgtcaaacatgtctgttatgttaacttaaatctcccaataaccctgtactgaggtcgatattattagacccgttttatagattaggaaactgaattttagaaagaggaaggtcaaaaaggctccaaagctcaaaatgctgagaccattatttccaggacaagggctcctgggttttctgtgggtttcccagatactagatttggttcttagcttaccagcaaggtaggtaggaagccaaccttagcctacccctggggttgaaaacagaggttttttgttttttgtttttttttgacaggatctctctctgttgcacaggatagagtgcagtggcaagattttggctcactgcaacctctgcctcctgtgttgaagcaagcgattctcatgcctcagcctcctaagtaagtattagtagctgggactacaggcgtgcgccaccatgcccagctaatttttgtactttttgtagagacagaatttcgccattttgcccaggctggtctttaactgggctcaagcggtctgcttgcctcaccctcccaaagtgctgggattacaggcatgagccaccacgctcagctggaaacagagctttttgattagggccagaagcgtccccctgcaactgcatatttgactaatcctggcttcagcagttttaacattcccatgagcaatagatggaacccaagtttgggtttggatcagctccagtgtgcttcagaagtatgatgctggaggttgctggagtctgttcctaagcagagggaatagagccctcttctggcaccctgggcagagctggcatattcaggcagccaaaaatggtcagtttccagtctacaaatacttcctgtaaaacttgctggcaggaagctgggtcaagcaggaaagtgacgctaaagagtgaagcccagctaggtgtggccccggataggggctttgcccatctggagacttactttattaatgatgggtctgcacttcttttatttcagcagctttgaagttttatgggagttgaaggaatctgttgttcttggctgcctggatatgaacccattactcaaattcccttcctctttctctgctctgtgccctcctcaatccccagcttgagtcttggctatgcctattactgggggccttcccaaccagttgctattcaagtttttccaaagaaaacagttctggaaacagggctctctgagttctccttccatggtgttataaaatatttagtctccctagaatgggtggtggtgattgtctcagatcctgaaagttaggcctgccctctgttgaaagctaaacttccaagcagtgccagcttggagtttttcacggaaacaaattgatccagcctcctccacatagttttttttttagatcaataatagtatgcttgaagtatctactgttttctaaatgtcaggctggcactatggcttactaaataggctagtggatcaaaagccaggttttttttttttttttgagatggagtcttgctccgtcacccaggctggagtgcagtggcgcaatcttggctcactgcaatctccgcttcccgggttcaagcaattttcctgtctcagccgccctagtagctgggacaacaggcacacaacaccatgcctggctaattttttgtatttttaggagaaacaggatgtcaccatattggtcaggctggtctcgaactcctgacctcaggtgatcctcccaccttggcctcccaaagtgctgggattacaagtgtgagccaccgcgcccagcctcaaaagccaggtttttagcccctcctcccacactgcctagcagctgtgtggctctgggccagtgcctacctttctttggacctcagtttccccagctgtatgttgcaaggttcgaatcgagtgatctctgacgtctttttcaggtctgacagtttgggattctggactgtttattttcttagaggacaagttgaagttcagaagggagaagccatatgagattctaggatgcatgggttgaaataatgagaaaatgtaaaaagaggaatggccatgctaaggagctggtgtgtcagcccatgtgcctaagaaggagagatgagttggggctggagagtatttgccctgggggtatggtttggctaaggtgattttgaaagtaagaactgaagttaggttcagacactaagcagatggttttcttcctgactttcacgtgtggagagaaaaacaagaggggtttacctgggcctgaggttgaacaaaaggccatgcaattacggctggattaacgaagaaactaacttgctaaagtgacatcactgtttctgatttttttctttcaattttcacctctgacctgaactctgctcccacagggacaaggtggttatatttccattgctaaccctcacacatatggtaattggaggagtaactctcagtttccagtgtgcccttgtcttccagttgaaatgcttcttgaggagcttcggatgacagggctgggtcaaaacaaatgaaaggggacccttgtctctgacgccctctggagcagttggagtggttgaagaaatactgctaacccattaaggtgtgagtgaggttgggtgttgttctcctttctagaagctactgggaaaaggcacaggcataggaaaggttaaccccagtcaggttttatgggctgtattgagagtctggaagaggtcctagcagataactgtaccagttaccacttccaagtcaacagggaagaggctgacttgctgagaagtgagttagtcagtgaaggaagaggaggaggagcagaatggcccctaggctaaagattcaaagcaaaccttgttttccctcttatggaaaaaagctagttgagacagtgctgtcatccagagaggcaaaacagaccaggacctgccctgccctgccttggccccactcttagtagcaggaaatggtgggaactggagcctaaacaatggagtttagcttccgacctgatgaaggcagtgtgagtgacgctgtgatgactattctctggccaaggaagatactagaactctgggattgcgttggtagggcacatccttcttctggctcccctgccccacttatacttgccttcttctctacaccagcagccccactgaaagcccagcaggggtggccccctggggaggtggcaggtggaaatgaggtcattgagctcagacccaactgggctgactcacaacctctgccccagtgagacaaggggaccttcccaagcagtgcttcccagatgtgcccaggcttcctatgccagaatgtttgagtcttagccaaaatagttgccaagccagtgtctgaagacaacatgacaggagaggtgggtggagttgtggaaggagctccaggaatgtccagaagacccgcctccactacttgttggctgagtaaatgtgacctcagtgatgttaagtgagactgtgtgtgatgaggccgacacattgttggcattcagtaagtgttcatttccatccttctgtcacctgcctctatgcacttcagttttctcatctatgaagtggggatggtaatgttcatcccctcagctcggaggtccatgctccaggcaagttacttgtaattatttgacttactctctgcttttctctctgactcttccaaacttctctccaggaaagagccatcttatagttcagtgacatggggtaggtgaggggaaaccattgctaatcccttttgctgtagctgggctacagctcacctgggtgcttctgatgataggcaaagagagggttgcttatttgaaactggcaggcccagacaccaaagtacctctcagctgctggtgccaagacagaggtagcatctggcctggttacttttgtgtctcagcccagctaactggagacatgagagagaacccagtttgttgaaggctttggacagtgtaccaccgagatgagtttgtttgtgcttagtgaagtgcttggtgtgggaagcgtctatgttgaattgctcagtaaataacagtgggcttattgttcttgggcaacaggtgggagggccagtgcatgtgagaggatgacactcctccttccccaaacacacatgcagacattttgttattgttccttcaaaccttaatgttcttctgagacacagtctttaacctcatgctgtgcctagatcctcagggcctggcttaggcagggatctaggcatataaacagttctcttctggggactacatcttgaaatgctaccccatccgggtcagctcctgtattcctgtcaaactgaaggactggctgggaattttctgccaactttggaaacttcatttttaggttctttcctcccaaacaagaccactgtcttctctttagggagagagcagcgtctaggcccgaaaagaagaccatgggtgcctactaagggtgagcatccagtgggccctctgtggcagtgggtctgggcctgcagcccatcttgcactcttgaatccctgattaatctaagagagaacaaagggaccttctttgatcaggacttctatcctatctatcactttcaggccccagctgttactacccttactccctgctacctctgacacgtacacagaaaacaggagagcatagaccaatggccttgtcctcatgacttagtttttttctaatttttaattttaaaatttttattattttttaacttgatttttttttttaaatagagatggtcttgctatattgcccaggatgatctctagcttctggcttcaagctgtcctcccaccttggtctcccaaagtgttgggatttacaggtgtgagctgctgtacccagcctaattttgatttttttaacctgacacatcataataaatgcatacataaattgtacatatttatggggtacatagcagtgttttgatatatacaatatatagtgatcagatcagagtaattagcatactcaccatctcaaacatttatcatttctttttgtgagacagggtctcactatgttgcccaggctggagtgcagtggcatgatcttggctcactgcaacctctgcctcccaggtttaagcgattctcctgcttcagcctcccgagtagctgggattacaggtgtgtgccaccatgcccagctaatttttgtatttttagtagagatggggttttgccatgttggccaagctggtcttgaactcctgacctcaggtgatccgcccacattggcctctcaaagtgcggggattacaggtgtgagccaccgtgcttggcggggtgtttaactttctgtgcctggcttatttcacttaacataatgtccttcaggctcatccatgttgctgcaaatgacaggatttttatttatttatttatttattttgagacggagtcttgctctgttgcccaggctggagtgcagtggcatgatcttggctcactgcaacctccgcctctcgggttcaagagattctcctgcctcagcctcctgagtagctgggattacaggcacacgccatcacacctggctaatttttgtagttttagtagagacggggttttgctgtgttggccaggctggtcttgaactcctgacttcaggtgatctgcccatctcagccacccaaagtgttgggattacaggcatgagccactgtgcctggccaggatttcattttttatggctgaataatattccattatgtatatatgccacattttccttatccattcatctggttttggacacttgggttgattccatatcttggctattgtgatgtagtgatgcagtaaacacgagggtgcagatatctcttggatatactgattttttttcctttggataaataaatggctagtagtgggattgctggatcatatggtagtcctatttttagttttctgagaaacctccatactgttgtccacagtggttgtactggtttacagtgctgctaacaggactcacatttgcttctgagttaagtggagacaggaatgggaattcttttgtgtttgtttttctttccaactttttaaaaacccaaaattatttatctccacattgaagttcaggaaacctcaggctgctatccctggggaagaagccatagtggaatggcagaaaccctgagtagagattcagaaaaaacaggttctggttgggtttcagctcacaccttctgattttagtagagcccttttaccagggtgatcctctacgagggaggaagcatggccaaccctagcctctctgacatgcttattcatcactcaggatgggcccttctttaccaattgatttatttaataaatatttgtttaacgaatatttgattacgtactttgggccagcactgggcttcacccttgatcagtgccctgaagacgctggattggcatgacctacaattgacatgatctgttcgagacactggcttgcttcctttgaaaattatttccaatattgtgaattaaagggaactcctaggctttaggatatgtccctggaatcccacccccccttagtttccttcctgggtgttttcttccaaaaagcctggttctgattgtgccccaccctgcccagaacctctagactggctggccactgccaacaggattaaggcccaaccttctagcatagccttcaatgccctccacttatcttcctagactctgccctctcttcactttgcaggcctcattcaccctggagtaggactgacttctaaagggaccatctgcatccttgcctccttctgggccatcatacatgttgttttctctacctgggacatttgagtgctcttgtgcctaccctcacagtctttcttttccacaatccagcttattctttggaaatcagtgcaaacactactttgaactgtggttcctaatttccacgaaaggttttctctgttcttctattatggcacttttcagggtctcccttgtacattttagtttttgtgtttttcagtaagtgccttgagatcagggaccggttctactggtctgttccaaccatagttccttaaacattgtgttccattaatattgggtgaattgaaatgaatttataggaagctccttaacctggggtcctcagacctctatggggtccatggacagaatttgaagtgggaaggatatatgaacttggatggaggaaaattacttatttgttttttaccaacctctcctttgtaatttagccatttgttcaattataatgtaggcaaataaaaataaaaataaaaataaaataaaggcagcaataatagcagtacccatgaccttgttaccaactcttaggctgtggagtgttttcctggattctaccctttttttaaggtttcttaataatagaagtttatacagaaactatctaatgtacttttttttttagatgaagtcttgctctgtcacccaggctggagtgcagtgacgtgatctcggctcactgcagcctctgcctcctgggttcaagcgattctcctgcctcagcctccagagtagctgggactacaggcgtgcaccaccatgcctggctaatttttgtattattattatttttttgagatggagttttgctctttttgcccaggctggagtgcagtgacgtgatcttggctcactgcagcctctgcctcctgggttcaagcgattctcctgcctcagcctccagagtagctgggactacaggcgtgcaccaccatgcccggctaatttttgtattattattatttttttgagatggagttttgctctttttgcccaggctggagtgcaatgacgcgatgtcaacttgctgcaacctccgcctcccaggttcaagggattctccgacctcagcctcccaagtagctgggattataggcatgctccaccacgcccagctaatttttttgtatttttagtagaggtggggtttcaccatgttggtcagctggtcttgaactccagacatcaggtgatccacctgcctcggcctcccaaagtgctgggattacaggcgtgagccaccgcgcctggcctaatttttgtatttttagtagagatggggtttcaccatgttggccaggctggtctcgaactcctgacctcaagtaattcgcccgccttggcctcccaaagtgctgggattacaggcgtgagacaccatacccggcccctaacatacatatttttatatcacaattagttattgtatatttctcaaaatattatttatgctcaatacacgtttgaaattacagtggcaataactaactaataagacctagtgctcggtaattacttaatatgataataagcacatattattaaattttgatttatatttcaaatatttcgatataattttgttatattgtatctactttatttcatgcatttacaaatattctaagaaggggtccataggcttcactagacaggcaagaatgattcgtggcacaaaaaagtcaagatgtcaaatttccccatctttgtatgtgtatattatgctgtatctatctccaatatcccttgtttggtacccattcatttagccaacatcttgcatgagtacccattgaatcttgagtactggaaaggtaattctaagtaagacgtaaactttgagttgagaatgaagtctattattctaaaaagcccactgccccctttctattctctcctgtcccttcagtcattggtgttttgaggtcacccttgacccagctcaagggtgatttgaggctggatatagtatggtgcccctcaaattccagtccaatggccccatcctactttatgacggcccattctgtaggggtcactgacttggcaggaagcctagggtaggaccaaatcaaagtggctaaccttgccttactcccactggggtacttgccttacttgttcctgccttcagggcctttcctgtcccattgtcaatcctaaaatagatttcctccttggctccctagcgagatttatttacaaagttgttttctgggcctgatcctcatcgtaattgtttatctggcaaaatagctgcctggccccctcttccctgctcctgacccgtgtgttcaggaaagtcctagaggttcaaagactgataaggtttaatgtcttactcactccatggaaatttgcatctttggcaatactatatctagtgctttccctcaatactataagcagtatgtgaccaacttagaaaatgtagattagattttttttttttttttttagtttaaagaaaggagaaagcacccataagatcaccaccccaaaaccaagcctgactaatacttggacaagattccaatcatccttctatgtatacattttacaaagttgagctcacggactctatgaaatactgtttacatttcctcaatattactaaagtgtcttccgtgagcatgaaatagtcttcataaagattttgtatgaccatataagaagccattttgtggctgtactatatacattatttaagcaaaatatctaacaactaaaaatcaatcttttttttcttttaatgggagacttttgtactctgtaagaggaatttagcatattggtttacattgtgaggtttggatttagacctggattcaaaccctgtctcccctgcttaatagcaatgtgactttagacaaatacctatttctttatctccaatgtggagataatactctacttcacagggtgattattgatattaaatgaggtagtacatatgaagtgcctggtgagtagcaagtcttgatacaggaaagctgctgcctgttactattactactgctaccattactactgagttttcagccaaaggactaaatctctaattatgaaatttcagctatcattgacctagcttcgaggatctatttgtaaaggtggtattttttctagtgcccgtgaaatcatgtgtgtggctgtctcttattttggtctgggcctgtttctgcacctttgtcctcccactgagttggctttggtagcccctctatgccacccatacccacctctactgaggcccccttcccctcttgagcctaaggaagccaatgagacataaatataggaagcattagcaatgcaaggcagtatatagaaccaccgacatcagcactgaaatggtctttggaccatttatctagtttaattggctgccctccatcccattcctgcctttgcacaggtaagggaaactaaggcccaggaaaaggacaggagttatccaaggttgtagatttgaccagctacatgctaggcttggaatccagtgttcttctttgtttttaatttttattttaagttcaggggtacatgtgcaggtttgtcataaggtaaactcatgtcatgggggttcattgtacagatcattttatcacccaggtattaagcctagtacccattagttattaaaatattttttcctgatcatctccctcctcccaccctccaccttctatgtgtctgtgtgttctcatcatttaattcccacttataagtgagaacatgtggtattctacaacctctgcctcccgggttaaagcgattctcgtgcctcagccaccaaagtagctgggattacaggtgtgcaccaccttgcctggctaatttttgtgtttttagtagagatggggtttcgctatattgtccaggctggtcttgaactcctggcctcaagggatgcgtccatcttggcctcccaaagtgctgggattacaggtgtgagctaccatgcccagtctggcatttgattttctgttcctgcattagtttgctaaggataatgacctccactccattcatgttcctgcaaaggacatgatcttgttgttttttatggctgcatactaacatacattttctttatccagtctaccattgactggcatttaggttgattccatgtcattgctattgtgaatagtgcttcaatgcacatgcgcgtttatgtatttttatgatagaatgatttatattcctttggatatataccccataatgatattgctgggttgaatggtagttttgttttcaggtctttgagaaattgccacactgttttctaccatggttgaactaatttacactcccaccaacagtgtataaaggttcccttttctttgcaatctcactagcatctgttattatttttttttgattttttaataatagctattctgacttgtgtgagatggtatctcattgtggttttgatttgcatttctctaatgatgtaaattttttatatatgcttcttggccacatgtatgtcttcttttgaaaagtgtctcttcatatcctttgctcacattttaatggggttgttttttttcttgtaaatttgttaaagttccttatagatgctggatattagacctttgtaagttgcatagtttgcaaatattttctctggttccgtaggttgcctgttaactcgatagtttcttttgctgtgcagaagctctttagtttagttagatctcatttgtcaatttttgcttttgttgcaattgcttttggcgtctttgttatgaaatctttgtccattcctatgttcagaatggtattacgtaggttttctttgagggtttttataattttgagttttacattacttttacatttaagtctttaatacatatagagttgatttttatatgtgagataaggatggggtccagtttcaatcttctacatatggctaaccagttatcccagcactgtttattgaattgggagtcctttttccattgcttgtttttgtcgactttgtcaaagatcagatggttgtaggtgtgtggccttatttctgggctctctattctgctccattggtctctgtgtctgtttttgtaccagtacaatgctgttttggttactggagccctctagtatcatttgaagttgggtagcatgatgcctccagctttgttctttttgcttaggattgccatggttattcaggctgtttttttgtttccatatgaattttaaaatagtttttcctagttctgtgaagaatgtcattggtagtttgataggaatagcattgagtctattctatgaattgctttgggcagtatcaccattttaacaatattgattcttcctattcatgagcatggactgtttctccatttgtttgtgtcatatctgatttctttgagcagtgatttgtagttcttcttgtagagatctttcgcttccctagttaacagtattcctagatatttattcttttgtggcagttctgaatgggattgccttcctgatttggctcttggcttgactgttgttggtgtatacgaatgctagtgacttttgtatgttgatttttgtacactgagactttgctgaagttatttatcagattaaggagcttttgggccgagactattggattttctagatataggatcatgtcatctgcaaacaaggatagtttgacttcctctcctcttgcttggttgccctctatttctttctctggtctgattgctctggccaggacttctaatactatgttgaatatgagtggtgagagagggcattcttgtcttgtgtcggttttaaaagggaatgcttccagctttggcgcattcagtatgatgttggttgtggctttatcagatggctcttattattttgaggtatgctccttcaatacctagtttattgagaacttttaacatgaaggggtgttagattttattgaaagctttttctgccctttagattatcatgtggaacccagtgctctttgtcctgatattaatttgcctctgcaattgtttaccagtgctatagataatccaggtagatcagaggtgagaagagaaccctgtgagatgaagctgtctagtatagatggaaaggccttcctggaagaagtacagttatcatttgcctgctcttagttgtaggctgatctgcattcttttttaaaaatttttttgagacaaagtctcgctctgttgcccaggttggagtgcagtggtgtgatctcggctcactgcaacctctaccttctgggttccagtgattctcataccccagcctcccaagtagcttgaactacaggtgtgcaccaccatgcccggataatttttgtatttttagtagagatggggttttgccatgttacccaggctggtctcgaactcctggcctcaagcaatccacccacctcggcctcccaaagtgctgggattacaggcatgaggcattgcacccggccttcatgcttgtctgttctttggtaagtattgctctgtggctgtgttgtttgtcttcaataagctgcttgggagcaggggttgtgtttgggtcaatattctcccttcatccccatcagtatctaagttgcccaggctcttagcatcctaactccttcctctgtggttgagcagagacacttgtctcaggctctgttgaacacagagccagatgactaacctgcttcctttgatctcatcctagatcagtgtgcgtgtgaccaccatggatgcagagctggagtttgccatccagcccaacaccaccgggaagcagctatttgaccaggtaaggcggagactccttagcctcctctccttctctgaatagcttccaccacaatgccaacaatccatgacttttgcctcttgtcaaagaatctctcttcctgttcactccaagatagatcaaaatgaaggctgattccagacttaatatgaaaggaggcaaagttaaactttggcagcctgcaccctatggtcctgattaattttatctttggtcctgaataagggagaaaagaaaatggtgtatattctatgctagatgctttaaaaatcttagcatatggagccttccttttaactctgaaacatgtaagtgatgtcttctccattttaatgatgaggctcagaagttaaataacttaattgcacccaaatgatatttggctgggatttgcactccacattgttgccactgcaccacactgcctctgtcccatgtttttgcttcctagtagaaggaaactaacttactctccctgaggtagtaagctctatgcacatttctctcaaaagaatgttgggacttaggacaacatgggagttgatggatgcagtaggaggctgcttcatctcctacaggcatgccatgaagataattgcttactcgccatagtgaagaggtcattcccatctccaacccaaggggtgtcccttcattgtgaatcattattgtcagaaaggatgtactgtatactataataaacagatggcagctacagacatttttagcattcaagggaatgtgccgtctgtggccagacttctaggagcaaaaatgaggctcccatttccagaggctgggacctcaccagacaggccattatcctatttctccaccagactccgatgaagtggaggtctgagttattgtccaggatgttaggctgcatatcaccctgatggattctccaggccctcttgcttccctttcttccttgctctctgtgtccttctaccatatgagaacttccccagggttggagagaggaagaaaaaaagaaggaggtagtgttcaaataagctaattctattcctgtgaatacttctgactggtgagagaaaagacaagagtagaatggagacaggggtaggagagggctagaaatttgaggacagcttgggtacaccttctgagttcttattacatagagtgggaaaattattgtctgtggctaatacagatgagagttaacatttatccaggactcagtgtatgctaagtattatgataagcatttgactatcacaaagctctgtgagtgcatgaattagtatgggcatgttttacagatgaggacacaaaatcctcattttcctagttagaccctgggaaaattattgaactctctgggttggtatcttcatcccctccccccgagaaatatctaatacttacctcacaggatttttgtgagtgtgttatgttttgtatcttacctgttactcaaaaatctgattatagtggcatataaggatgtccaatccaaaaagataaattcgaaataggtgagaaagataagaaaacacaaataggaaagaaagtgttagctggaagaaagcatccagcatatggtagagaagtaataaatgatagctccctttccaataccattgtgcttcttgtattattaattgagctggagttgacgtgatgtggtggctcatgtctgtaatcctaacactgagatgggaggattgcttgagcccaggggctcgagaccagcctgggtaacacagcgagaccctgtctctacaaaaaatttaaaaattagcatggcatggtggtgcacacctatagtcccagctactcaggagattgtgccaggagggttgctcaagcccaggagttcaaggttacagtgagctatgatcacgccactgtactccagcctaggtgacagagcaagactctgtctctaaaaaaaaaaaaaaaaagtaaagaaaaataatctagaattgggagaattgggagatgggcttaatgatcctcagaatatctaacttcagatttaggtggaacttacttctctggagtttgttttgtgtttgttttactttgaatggcaaagtgtaatcattgatacttaattggtgaaaatacaaattagtctgaggaatatttaaatacaagtttactacaattaaagtgatgtgcttacattcacatagctcacaagtgattatggtgctagtctggaatgactaaatgcattctaattataattgtgctttgcattctctcttcacatggaggttatattggagaacttttaaagggacagcctagtgaagtcaaaagggcctggatagaaagtcatgaatcttgggctgtagggttggctctatcactaattcgctgtgatacaaacgtttcccttatttgggcctcagtttctcatctgtacaatgcctaacttgtttctcaaatctggttatctctcagaaaatttatctctggcatttatttgtgcattccatctctctttctctcccatttctgttcctagtattgggatttcagacaatccttttctgtaaaaaggagagaaatgcctcacctgagtatgatcagctgctggcatatgtgaggaggtagggctagctggcagggggatcatctcttccttgacaggctttttactgtctctaagacaaaagggaggaagtgtccatagaacacataggcttttgggccctttgctttagacagcagtatcattctgggtagcagctattagagagggaagcggttagtcagtgcagattttacagaccagctgggagccagaggctcctttgacatttacctatactccttccaagagccctgattctactaattccccatcccaaaccagatgacgccatcctctaccctcaacactgggggctttgtatatgtgcattgcagggggatggctgtggaggatgaggaaggcatgatttggagcctagtgggggcagaaaaattcttgaacaaagaggtttattaacttcaaaaaacctcaatgcctggtagttttttgttagtgttggtttggtttgtgtgctgtgggtgtggatttgagggaagtccagatagtagggaaccccagatagtagggaaccctgggcagattggtatgctagttctgaatgctactgcttccaaaacaaagcctttgggagacttggaaaccaagaagtccatgacttctcatcattgttatcttgagaagtatcatttattgagcacatactatggcctattcctggctaggcgctttaatcctcacaatgctcctgcctctgtgaggtgaaagaacatactctaggtcatgtagttagtaagttgtgatatggaattttgaatacaactctgatcacaaaactatacttttcctgcactgcactactctgtttggggtgattgggagtattcaacttagagaagactcaaggaagatatgctttctgtcttcagacctctgaaggactatcataagaaggaggggggcagtcacattctgtgagtcagagggacagaggtggaccccacaggtgagaaaatacagggaaaaagatttgaactcaaggaattgagcatttggccctcttgaggccaaggcaggtcaggtcaggaatcagtagagttatgtgttcataggcatttgggggatgtgagctcttctctctctaacttgatgaggcataagggaggaagtccgttctgtctggctcttgggacccatcattcaaggaggccctcctggtagagcctgggcctgggaggaaggagctagactccttggcaggaattggcaaaagctttatggccatcctggaacgcagcagtcatctggccaatgaccagagaggaagccaaccagagaggaagtactccttggcaccagcaataaataataggcaacaatgggatgccatagcttgaggaagtctagggcctggtgggaaagggaagtaggactcatagtttgtctcatttacctctcttcttgtgagtgtgctacagctagaggggagagagaacatgttttgctatagtgattttgtcacttgcttcaacttctaaagcttttgatcttggattacctaggtgccactaaagggctgtgctcaaggacagaggtgaaatctcaaagcatcgattcattcatctatttactgattcatttaatattgactgaaggtctacactgtcgaacaccatctctgttcttcaggaacttggagttccttacctataaaagcatagaaaggcacatgcaactctctacccacaaagaaagaaataaacgcccttgaggtcaggttccatggggtgatatataaagcataggatttagaaccagccctgagttcaaattctgtcctgttacttcgctgtgtgaccttggatggctcatttagcctctcagtactttcctttcctttgtaaaatgataatcatgctaatctcagattttgtgatttaatcctcaaataagtaaaatgcctggtgcataccaagcattctaatattggtggttcttattaaggactaaagtaggtggcattgccctgagagttcagatgagggagctatgaaatcaggaagttcttctggctcagtaaagtacttaggacttgaatactctgcaataaggacagtaaacctttttttttttcattttataaaataactaacatatattatagtaggaggatctccatcttacagatgaggaactgaggcttacagaggtgaaattatctgtttaaggtcatatagctaggaagtggtatagctggggcttaaaccagggcacatagcatttccagtttttctaatgcttttgatcaactgtcctctggaaccttcttccactttacctgcttccaaaacttagaaccctagctaggttgggcatggtggctcatgcctgtaatcctagtgctttgggagtccaaggtgagaggatcacttgaggctaggagcttcagaccagcctgggcaacatagcgagaccccatctctacaaaaacttaaaaattagctgggcatggtggtgcatgcctgtagtcctagctacttgggtggctggggctggagaatcacttgagtccaggagttcaaggttacagtgagctatgattgcaccactgcactccagcttggttaacagcaagaccctatctctaaacaaacaaacaaaaaacgataaaagaaagaaacttagaacctcagctgagtatgttctctgttatagagcaggtgaccacttgaccacaggcaatgtgtaataacagaaacagcaatagtggtagcccatcttggtgctttccagtggtgcaataatttgctttcaggtgggtggctgatgcagatgctgccaaatctgtaatggtatcttgggggtctcaggtgtttgggcattgatgcagttttgcacattgtttctcacacagttcttctcttgtggctccagcattactccctcattctcctctaggcgtgcacgctcgtgtgtgtgtgtgtgtgtgtgtgtgtgtgtgtgtgtgtttggagacaaggtctcgctccgtcacccaggctggagtgcagtggtgtgatctcactgcaaccttcgcaccccacagtctcaagtgatcctcccacttcagccttccaagtagctgggaccacaggtgcccacaccagctatctttttgtatttttagtagagatggggtctcaccatgttgcctgggctggtctcgaactcctgagctcaaaagatctgccccgccccagcctcccaaaatgctgggattacaggatgagccactgcgcccggccatgctctgggcttttgaagtggctgatgacatcactagtttgtttactcagataaatgcatgggggattcaagaagagaatttctgggcttttgaagtggctgatgacatcactagtttgtttactcagataaatgcatgggggattcaagaagagaatctctgggctcctaagctgacctgatctccgctcccctctacagacctcagatgtaggttgcctccacatgtcaaaaggaggtaaagggtttttttttcttgcttccagaagctcctgataattaacgaggatgtactccaaggcagatcttttcttttcactgcacctcagttttccattttatgttgcttgaaccctgtaactctccacagtcatggagctgagtagaatacacaacctccagtttcttaagctagtgtcttaaaaactgaagtcctactttctttaggtgtatggggcaggttccaggagggatacaaagctgtgagatgaatgtggtttagtattctagagcattaattttacttgcaataattttaaaaattcattatttatggagtagaatataaaatttgcacaaataattaaacctgaggcttcaaagaaattatagctgggttacagccatctacctattatctccccctaccccatcctaccacaccccctatgtcccttgggtatatgcattcattattttctgctgcttaaggattttttccatgggagctttgagaaatactggctcagatccgataagctggctgtcgggtcaaagggagccaataaagaattttctttttcctcagggataggaccatttctcagagtggaatgataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgagacttcagtgcaggctgagagatattactcatctctttaagccctagagcctaaggaagtggaacatttatgtttctgatttctttatgttcacaaaggaagagacagtgctcagagagatcaccctccctccccccagcactgagcctgaattctctctttttttttttttgacatcactttaggtattactttgcccaacttctcctgagttactctggatctcagaactactttagtcaccatgatccttctctctctctctctcttttttttttttttgagacagagtttcactcttgttgcccaggctggagtgcaatggcgcgatctcggctcactgcaacctctgcttcctgggttcaagcgattctcctgcctcagtctcccaagtagctgggattacaggcatgtgccaccacacccagctaattttctatttttagtagagacggggtttcaccatgttggtcaggctggtcttgaactcctgacctcaggtgatccacctgtcttggcctcccaaagtgctggcattataggcatgagccaccacacctggctaatcctccttctcttatcacacccctactcccacccaatagtgaaacagacaacgtggtgcaaaaagaggctaacggtctcactcctgggatttctgggactggctgcatagtctgtgcctacctcacttcctttcagtcttggagtctcttagcctctacaattagtctgttagtacaggcaaagaccagttgctgcttgtctgagtccattttatgtttgttttgttttgtttttgtttgtttgtttgtttgtttgtttttgacagtgtcttgttctgtcacccatactggagtgcagtggtgcaatctcagctcactgcatcctccacctcccaggttcaagctattcttctgcctcagcctcccgagtagctgggactataggcacgcaccaccatgcccggctaatttttttgtatttttagtagagaccaggtttcaccatgttagtcaggatggtctcgatctcctgacctcatgatctgcccatctcagcctcccaaagtgctgggattataagcgtgagccaacacgcccagcccattttatgttcttataataaaatacctggagctagttactttatacagaaaagaggcttatttgtctcctaattgtagtggctgtaaagtccaagagcatggcaccagcacctgctcagcctctggtgagggcctttgtgctgtttcataatgtgacaaaaggtcaagtaattcacagggacaggggtccccatgactgaaacacctctcattacatactacctcttaatgattctacctcccagcactgccacaccggcaatgaagcatcaacatgagttttggtggggacaaaccacatccaaaccatagcactgctctactacttctgttccaagtctgttctccccccatgacctaatatcctggccctcatggtccatcttcttctcttcagcatcttcagtgggtcttctctctctctctctttttttttctctctctctcagctggattgtttcttggatcttgccttttcccaccaattgcatctggacacactattcttctgcaaccctgtggaaaatgattagaactgttaattgggccttgggccctgtttagatctaggatgatatacaaggtgctttaaaaaaatcttttctgttcacgcccacccactaccttcatcctctgcaaaaagccaatattacatttcaacataagcattcacatttctccatctgaaactttctggcagttccagctgcctattgacttagagtcagggaatcaactggccattgaattctggaagccttttgaactttcctcattacctcccacccccactgatcttttctaaacatgtttctaattatccacatcagcaagaggtagctgggaaatgggattgtttttattaaccatttgcaaaataaccttgtaatgtaattagtacaatgatagaacttaagagaaaaaagagatcattgaagccatactccccaatttggatagataaggaaggcgaggcccagagaggaaatatgctaccttgatatcatacagctagttggagacagacatgaacattttgctcaggtttcctgatacttgatccaagctatgaaggggaagggtgacctggtgagcaatgaaggtcgatgacttgggggacatggcttctccccaaagtggttgtcgcttgggtctagtgggaatgccaggaagcatatctcgatgcagaagtgatcaaagtttattacctggatgggaaatttgggccaaaggagagacaaggcaattaatcacttgagaagctcaggagtcgtaagctcatatgagtacttggcattaggacatagcatgctagagaagaaaaggtacaagctctatagtcagacacatcatggttctatatggctctgtaattttagatgcattacctctctaagccttagttcctcatctataatatgggtataattgctatctcacagggttgtttactgttcagcgcctgacacatgattggtgcttaataaatatgagctacttttttctttggggtctctgaagctctagattgtaaactctgggtgtgactgtggggcctgactttggatgcataatagaaactttgtggatacagtgttagtgtgtgtatgtgtgtctttgtgagtgagtgtgtgtgtgcatgtgtgtgtgtgtattttgaagggagatattaatttgttcataagggaaggacatcagcaaaactgggtccttgttccctgcttccatctccaggtatatttctatgattctttctcaccttacccttaccctccacttgcatccttctcccaaaaaacaaaataaaaaagactgcctaaggccagcctgacctcattaggatgtggctcagcttcactgctgccatcgacagtggtgggtatgctggggttgagctgagggccagactattaacatgctaatgtcagggactagagaacagagctcatctgtgttctcttggcaagcctccttttcctgcccactgttcagccaggaggctcaggacaacagggggcacctcagctgctacactgaggtacttaccctatttctaccctcatttccaccctaaacctgtgtaagaggaatcatgacttggctctgatcagggttggaaaaaatcctctcagaacccaggcacagcatggcttcagagtccttcacaatccccgttttatcttctcaaacattctttatttggggtattgtaaatggaactcagtcttaagggtgtgggtattacccccagttgctaaggatgaaggacaatatatgggagtggcccaagagaacaagatacaggagttaatccaacaatctccaccttcagcctttaatccatcatggaagtgggaagtggtgtgacattgtagagggaaggaggaggtggcagaaatcactggatatgcatggatttggagtcaaacagacctggtttgaaccctaattctgtcactcacaacctgaaacttgggcaagttatttcatttatttgaacctcatttttgatatctataaaatgggcctaattgtaagtctagcataggggtattatgaaaattaaaggagatgatggatgtaaggttcttggtatgtgtcagtgctcataagtaatagatccctttcctgcctcagcagtactttgtgcagagagatgccgacatcagttcttgattgctgctcaagtatattttcttgccagatgctgagcaccttaaaccctttaagggcagatataatattgacttcaaactttgtgtcctctgtgcctcacacagaggaagtattcaatcaatggttggttgttttggttttctcttctaggtggtgaaaactattggcttgagggaagtttggttctttggtctgcagtaccaggacactaaaggtttctccacctggctgaaactcaataagaaggtaactgcttattcctctgttggatttagaattcttttcttttccagaacattcctgggagggtaccatgtgctagttggcaaatcctggatacctagggctgtgtttgtgactgggtggtctgttgaccacttggatcagaataaggaccgaggacacaagcaaggcaaagctcttgctctgtctctactttgacttctaacagcgacaatggccagcattcaaagaagaagagactcttttctttctaatgggaacactagcttgaactttgacttgttttggatcaaatccattagtggcttttcaagagaggattggtatccccttcatctctccaaactcaatggctttaggggatttgtgttttttttgtttgtttgtttttgttttgttttgtttttgacggagtctcgcactctcgcccaggctggagtgcagtggtgccatctcggctcactgcaagctccgcctcctgggttcacgccattctcctgcttcagcctctcgagtagctgggattacaggtgcctgccaccacgcccggctaattttttgtatttttagtagagacggggtttcaccgttttagccaggatggtctcgatctcctgaccttgtgatccgcccgcctcggcctcccaaagtgctgggattacaggcatgagctactgagcttggctggggatttgttaaaaagagccacagattcttgaactagaaaaaaaaaaatctgaaagatcttacagtcttatgctgcaccttctccagcagtcaactaatgtctgaaccccatatagatgtttccctctttcttgatcttttacctcagttggaccccaaatgggatggtttgagtccatgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcattatttttgtttttgtatcacaataacacacaaaatgaacaaagcaggcaatatccttatttcctggcgaaggaaatagaggtgcagaggtactcacactgactttccccatctggtgcagctcatctgaggcagagccagagccagacctggaagcttagcaccttaatattttaacactaagttttttcctactatacccaatggccatttccatagtcttttggattagaaggaaaagctttgcttcattctgggagcctcagtcccattggagttatggcatatatgtacaacacacccataagatattagggatagtgcttgtaccctggggactctacctgagtcattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggacattggtggatgttggagaaagagggaacagggacgatagaaggcaaactaggaccattataaggctgttttttgtttgcttgtttgtttgttttgctgaatgctggtaactggtagcccaaacagttttgactatcaagaaatggagggagctcttacacatggcaaagcatttttgagggttgtgtagttgaaggacaaatatcatcattttgccatcaccacattctgagccctgctaagaatgtgcctttataagaggctgtcacaatgaatgagagaaagaaaattgcttctatggcagccaacatgccagaggccagcaagggtcagcccatctttattccccttgggagcttagaccctaggtttttgttaggagattttgctttgcaaaagtcatgctgtgctctgttctccatcatctgcttgccttttgtcccctttcccactcctgatagcaagatccttgtcagaagtacagagtaagcaggctttctatctccttgggtctgactcacaagccccactttgtgacccccaactctgtgtcatttagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacaggtatatctcagatctcttttagtttatttaggtcacgttaacatctagggctcacttttcaccaaggagcagggccatatctcttgggtcccatctcagttctttttctacctaatttagtccagcccagatgatttcacaacttcccttagtcaatactaaatcctgtattgactagactcacactgtcaactatggtagccaccagccacatggggctattgaacacttgaaatgtggctactttgaattgagatgtgctgctgtaagtgtaaactacacactggactttgaagacttagtgtgaaaaacagaacgtaaaatgtcttaatattttaaaaaatatttatttacatgtttaaatgataatattttagatatattgggttaactaaacttactataattttattacatccatttctttttacttattttcatgtggctactagaaaacttaaaattatatatgtgacagtcattatgtttttattggatcgtgcaggcctagactatcttatcagcatttgtaattagtctcctgtgatggttaagtggcttttggcctataatcctctcactgtagccttatcccacttgcttatatttttcacttggtgtgctcttggtgaggatggagagcaataaattattgttccatataactcctgaatcttggagttcattatttactttctctcaaacttttgtaagcttggatagaagagactcagttaaatagggctggggattcccttgaggaactgttacaagttccatgcctcaaacaaatacataacaaaacaaacttgagacaaggaatcatatgttagttgtactatcaggagatctttagtgaactctcaatgctggcagctgacctggtggcgtgtgatgacactggctgagctgtcactgagtctacctcctccagagagaagtgtttgtttggccaggctcagtggctcacgcctgtaatcccagcactttgggaggctgaggagggaagattgctcaagcccaagagttcaagaccaacctgggtaacatagtgagacctcgtctctatttattttaaaaaaaaaaaaagagagagagagacatagaagcttggaggtgacagtgagggcaagcccccagttctctacacccttcttgtcttgcccttgtcctgatgttattggtttctatttctacagactaactcccaagataggcttcccctggagtgaaatcaggaacatctctttcaatgataagaaatttgtcatcaagcccattgacaaaaaagccccggtgagtgattcctccctctgaccaagacaggtacttgccaaggcctgcataatgagcaatcatgctattctatttttctcttccttttctgatgtgtttgtgtgtacgtgtgtgcgcgcatgtgcacgaacaggaagcacaaatagagattgggaatggagggggatgttgatgccaagaaatggccagcagacatcctgtacctggttctactctgctacctgtctctctcactgtggatgtgggagagccacaggcagtgttaagaactgcttcttagccattgcctctgctgccctgaggttctggggtggaaaccgaatgcatctcatatttccaagcccctgggtcccagaaagtggacactgttcacatatttgattccttccttccttcctctctctctctctctctttcttttttttgatggagtctcgctctgttgcccaggctggagtgcagtggtgcaatcttggctcactacaacctcagcctcccgagtagctgggattacaggcgcatgccaccatgcctggctaatttttgtagttttagtagagacagggcttcaacatgttggccgggctggtcttgaactcctgacctcaggtgatttgcctgccttggcctcccaaagtgctgggattataggcgtgagccaccatgcccagcccttgacttcttttttttttattgtggagaaagggctgtggccaaagtccaaatctgaagatgatcctacagacttcttggtagaactttactgctgccctctcagacttttctccagagcaatccaagaccaaaaaagtgctttaagttcattcatttctctaacacactcgccatgcttcttacccactcagtagcctgcagctgacaagaccagacagctggtgattgtgggtaggttaggaaactgagctgagtgtccccttttctgggatactgcatgtccaacaaggcccagtgacaatgctgagcctgacccttttcatgaaggctcagtgattcttctccagccatgaggtgcctgaacttcccctgctagggactttacacatgttgtctccttaaaccctcagcaacatggtcaggtaggtactaagtagcatactaattttatggctgacaaaactgaggttagagagatggagtgatttgcccaagatcacacagctaaaaatggtagagctgggatttatacctgcaccccaagctatatgagacagtagcagtgtgtggtcagtggcagaggagatggtggtgcccatcagctggtgacttcggtccagtggtatttgtagtaacaaactcaaactcactggattttcttgtgtgttttcttttattgctgctgtgctcaactattatcagaaaaagttaagtaacaaagccagctgagatcaagggctcattttaaaaacaacaaccaggacaagcagtgatcaggagatttatgtattcatgtatgtatttacagcctgccttgttccaaaaaggatttaaggggctgggtctaggatttgcttttaggagattgtagaaacagtccagccacccatactgcacccaccagggtattattcaggggtcatttggcttccaaaagaggtcacctgagacctagcatgttccctaattagcagagaaagtttgaatccttcaacttgattaagagtaatttaggatgctttcacaagcaaagattgaaagaaattgtggtttcataagcaaagattgaaagaaattatgggaagaacatgggtttcagagtcaagaaacctgggtttctagtcttgggtctgtctactgtctaaccctgggcaagtcactttaccactctgataattagtcttcccatctgtagtgcaggaggtcagattaaatattctttccagtgcttttggatttagcttttcagaaggcagaagatcaccttcacctgtccctccaaattctttctgattgctgatttcccaccaggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcggtaggtgctgcacactgatgtggggggccagggctggggcaaggaagcttctcaaaggtgccctgcatgctaagtcaggacatgaggccaacctaggacttcatagatgagaggttagacaccaatattcacatttattcagaaaaaatctaccaagtttgaggggcagtttttacagagctggatctagcaggaaactgccctgtaggacctcacagtctactcagtctagtagcagagagagggaaaacaatatatacataactcaaggtacaaaggccatgtcattcattcacttaataaatatttattgagcaatgaataagaaaagaccaaaaatctctgcttttgtgaagctagcattctagtggggaggagacgaacataataaataagcaaattatgtggtacataagatggttaagaagtgctatggagacaaaaacatagaagagggatggggagaagggtaagccaagtattctgagggcccagatggagaatacctagccaagggagataagaaggttcctggaagaggtgctagggcaagaaaaagcaaaagcaaatacttattccagatttgtaacagactctgggaaaaagaagcctagagctgggctttagggcaggcagtgttagacctgaggactgatgcactagccgtagagattactagacttgaagcacttcatcccagcacagagccaaaacttgtctccctaacaaggtggatagggcaggtcttattggaccattttcaagataggggaacaagagcaaagcagtgacatagctaaggtcacccagtgggttggtgggagagctaggattcctgactcaggggtacattgacagggccccgtgtacactggcctatgtggggctatgatatgaggacaagggtatagaggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctgcctacttacttatagctacttttgcttacatgctggctttttagagcaggctaccactccatgggcctccagcaaataactagttcagaagcaagctgagaagtcactagtgtggcccagaaatttttgcagtcttccctaacccttagtttctgttcactttcttaactcttgggtatctgagctgattgacctggcaaaggaaagggaaggagaaaagaacaaaagggactcatatttgagctcctgctgtatgttgctgtgttgggaatatttcccttttccttacttatttcttcttcccagtaaccctatgggattaacctcatatgagataatatcccagataaggaaattagagctcagggaagagattcaccaaagatcacacaattgtagctaaataaggattagaacccacccatttctgcctctgtttgaaagctttgctccctgaaatcacatgcaaaactatgtgtctatgcatttttggggcatttggcatccatactttcatcacagtttccaagggttctgtgactcagaagttaagaacctgtggtccaaactccttgacatatactcttcctttgtactgttggaggtgggaatagagggaaccaagacctgtctctcatgaggaagctgtcatgggagatttacccaaggtgtgcataagcttttttccttgttcagatagctttgtgacacttgagtgtctttcctgtacttgtcctgggaagactcttagtcgaatcctgagcattctaggatatcaggaaaggatctgccacttcaggaagtgacccaatgatggccaaagctttactgaggcccccagctgcatacttgccaagaggggcagggggagagataatgaggaagggacagagatggcatattgtttgtcttcaagaggcctacagtctaggtgggggagctctgacttaaaaggaagtggtggtcagggaagatgggactggaatgaagtagtctggtaaaagagtctctgaggcagcaagcaagtggagcagtaggtcccttactagtcccccaggggacttgggttgaagacacctgggtcctgaggaccagaaggcccagctctcacaggcttccaatttatccgtaggccttggaaatggcagagctgacagctcgaatctcccagctggagatggcccgacagaagaaggagagtgaggctgtggagtggcagcagaaggtaagacacagggcctaaagcaaagcattgaaggaatgggtgccatatgcataggtaacagctccttagattccttatgttttggctccctccctctttcatacttcccacagcaggcagcatgggagaaggcactcatggtttcgtcaaatacttactggagttctctaatacctctaggaagttggtacaattgctcttgttttatggatgaagaaactaaggatcaggcagatgaagtgccttgtcctacctggtgcctgcctcttgccagaccgttctaggcatatacaggatgccacagtttaactggtctcactgacagtctttctctccttctgtcactggacaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggtatacaagtagggccaaggggcaaggaaactatatgcattgatttagtagcccatggcattccctagaccatcatgggggataggtataagatcctgtcccagtgttgtatgggagcccaagccgttcttaagtgacagctttaaggataggcacctctcacttattaatcagaccttgggctatctcttccctttttgagattttctctctgccccacctcccactcactccattcacctcttacattaagaaaatatctagctgacaaaattcccacctgaatcttttgtatgttgttctactcttaaaggatacccattatcaactggtcccctaagtttatttatttttttttaatattcttgccccactgcagttctaacagagttggaaatgactctcaatatttatatatagagagaaagggtgaggaagaaagaaggaaacagaagagaagggaagtctggtcaaataacaggaggtaaaatgagagaaagccattgacctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttca

SEQ ID NO: 1874 - DNA, 4544 bp, Homo sapiens
agattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattggtgaggacgtccccttcctggcctcgtacctggggggtgaggaggctgactttccgcggcctcagcatcctgtctcccatggagagaccccatttcctgcctcgggggcccgaagaagcctgcagagggagaaccatgcgggtcccgttccttcttaataaccggtcgcggttattaagaaggactggagaaaggtccggataggcggagatgggaaggaagcagcttaggcagaggctttcaggtagggccaggagtcagaatcaggcttctgtgggggcatctgggctgtttcaagtagagcaacaggacaggtggggcgattgacagtggactgtcttagaaacctcaagtcctggggaaatgcagcccttctttctactcactggcacttacataatatacatgcataggcgttggatacagccgcccacagacaggcacaccttgctgagttggaatcactgcaccataaccagtgggtctcctgagcctttctggcatgcccagccccttgctcacatctgccctggatcccagaagaagcagacctaccttggtaccattcttaggatccctaggaagggacagagatacaaacctgactttgatggccttccagaaagccagaacaccactgacatccctttgggtcagttagagccagtgggagctcaacttctcagagccgttgagcttcgcgtggcaccagtgaactggggaagccctctagaacaacccagccagaggaggtgggacagcggctggatcctgactgtgggtaaagaggtaggcactcccagggaggctgctttactctgtctcttccccacagaggaggattgccaaaagtatatcttgaagcagcagcaggaggaggctgagaagcctttacaggtggccgctgtagacagcagtgtcccacggacagcagagctggcgggcatcaccacacttgatgaccccctgggtaagggtccaatactgttcccatgggacaggtggaataggacattgtggtgttaagagcatgggtgtttgaagcagatgggctgtgagaccttgggcaagtcacttaatctttctgagcctcagtttcctcacctaagaaatggagataatagtcctacctctggattgctgtgagatgctcatgaaataatgtctgtctcgtggttaatccagagcttagcccctgaggtactcatctttcctctcctggaaagggcactttctctgaggagtatcatcttgggaagggtgcagggcccagggttgcctaggcaggggactcttggctggatccctcccaagccttcccatggagctctgaccaccacccttgtgctctgcacccagggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgcgtggatgcatgaagccctgccctggggtccagatactgggcatctcctcctagctgtgcactgtccagcctgggcacagtgggcccttcctgaagctattcccaggggatatgctgaactaagttgccacaggacctgcagcctgcccactctcccctaggtgccgccggatggtggtggttgtctctgatgattacctgcagagcaaggaatgtgacttccagaccaaatttgcactcagcctctctccaggtaagctcaaccctgctctggcaagagaatgagggaatgtgtaggtggggcctctggattgtcagccttccctccccaaggactgtggatgcagtaccaaagaactgctgaagatctctgcacacctgagcatgtgtgcatgtgtgtgcctttttgtgtgagtgaatgtgtgccaggggtacttagatgggggatggctgttgttaaccctggggttgaagactgggcttgtcccaccatggggcaagggcctgatgccagcatggcaccccttggcttgcaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaa

SEQ ID NO: 1875 - DNA, 4544 bp, Homo sapiens; identical to SEQ ID NO: 1874

SEQ ID NO: 1876 - DNA, 4544 bp, Homo sapiens; identical to SEQ ID NO: 1874

SEQ ID NO: 1877 - DNA, 4544 bp, Homo sapiens; identical to SEQ ID NO: 1874

SEQ ID NO: 1878 - DNA, 4544 bp, Homo sapiens; identical to SEQ ID NO: 1874

SEQ ID NO: 1879 - DNA, 51336 bp, Homo sapiens
aacttacattgcgtttattacaatgtaatcccaacttaaggagcatctatgcagctacagtaattcaaggcagtatggtatgagtgagtgcaaggatggacaaacatttcagtgtaaccaaacagaaagtccagaaacagatccaccattatggttaattgattttttactaattggcaaggtaatttaatgaggaaaggataattctttcaataaacagtgttacaatgactggatacttgtatgggggaaaaaaagaaccctgatccataattcacaacatacatatcaattcaaggtagatcacaaatataaaaatataaagtttatataatagagcagaatatctgaaatcttggggttaaattggagagaaaaaatatcaaacaaaagaaaaaaataaatttgaccttgtcaaaatttaaaacttctattcatcaaaagacataaagaaaacagtcaagccacagactaggtgtaatatctcaatacatatatccgacaagagacttgcatctagaatgtataaagaatttctatgacccaattatagctatcagggatatacaaattaaaaccaaaatgaaacatcactacacaccgattggaatggttaaaaaggaaaaatactgacaacaccaatatttgtaaagacaggaggtaccagaactctcattcattatattcataaattgacaaatataaaaactgctatagtagggcagtcttccttagaaagggattgtgggcatgacagagaacaatattaatctgtccattatattccttaactgtaaaatggagaccatatgttccaccagcttcacttggtaattatgatacatggctattaagagactcaaatgactccatttcatcaactaatatgccctgtcaattctacttctaaagtatcccatgttctatccaatgtcataccactatcataatttaagtgttcataactctctataatatttcaataatctaactggtctcaatgcctgtagtagaaattgcagattggctcacccaatttctgttccctaggaaggctgagaagcttttaaaaaaagaccttcatttccctaactcccttgcagctggagttccacctgcaagcagccagaacttggaagtaagttaatttggttctggcaagtagatgcacttccacaagatttggaaggtgagagtgatgtagaggccagcctcttgtcccttctgttgcttctgtttacaagggaagtcatggaaatatggcctccattcctcactgttccatttctcattctctaaacaactaatcagttgtagtgactcttgactggaactcccttcttgctggatcacaggtacatgaatatatttttgaacacagacttgaaaatcacttgtcaataaagtttgaaaaaagacattcattgtttcttaccatctccctttaaggtagaaaaagaaaacaatctcaccatttctactttataagtaggaaaactaggactctaaataagctcaaaacagacacccacccagctcagtaagaccaccaaaaaggggtacaggtctttccattctggtgaaaactaaacccatgtttgatgaagtctccacatggtcttcagtttctagtactagaataacatgtaggtgacatctgcaccactgaagccattttgtttggatcaccagagtttaggtaagactacagcataatggaaaagaaaaaatattaaaaacattatattgatattcctataatttttaatctactaagtaaaaaagcaaggtgtagaacactgcatatgttatgctatcatttgtgtaggaaattatttaaaaataggaatttgaataggactcaaaaatccctggaaagattcataagaaatgagtatcatgaatttttttctgaggggaaccaagtagctaggacaatggtggaagggtgactttagtctttaccttacgtacatttagaattttgaactgtgactatattaactatttaataaacaaaacacatttaaaaatgaaaaaaagatgcaatgacaaagcctgaaaacagaacaaacaattgttacatacaaaagaatcaaagttttgtgcattttatttaataaatttaggccataaaacattgtaacttaaatcgcttctatacactatatattcatataaccttgttggcctgaagtagatgcttactaggaagtttttccatggcttctttttaaaatcctcagttatcttctcctttttaaataaggattgtatctgcaaagaaagaaatggggttaaatgatatttagataagggatggtatttcttttaaaggtaaagaactttcaaactgtagtcacactttggcaaataggatgggaatgacaattttgtccttaggatcagatactaagcactgacatttttattttcatgtatccctttgatgttgctttgatgaaaatatggtaaaaacaaaaaaaaaatcaacaataacaaaaatcctttaaagctttaaaataattaatgaaaacagtttaaaaatgaaggtatgtttacacttctttctgtatggcttcaaagatccccattcctccccataataaaagcatatcatttgcacaaaagagcataatctacttaaatgtaattagcactttacaacattttctcctacagcagttaaacaaatatggctgaacaacccatctcatttgactaatgaaaaaccagtattgtctgtcaacacttttttttttttttttttttgagatggagtctctctctggagtgcagtggcgcgatcttggctcacgcagcctccgcctcctgggttcaagcgattctcctgcctcagcctcctgagtagctgggattacaggtgcatgccaccacgcctggctaatttttgtatttttagtagagacggggtttctccatgctggccaggctagtgttgaactcctgacctcgtaatccgcccacctcagcctcccaaagtgctaggattacccggcctgtttgtcaacatttttaccagcaatttatactgtcagttatgaaattagagaatcaatctaattggctgcaaaacagactcaaaaataatttcttcattctgtcttctcccctgatatctacctataatatagtattttattagtatttcagaggcaattattataataggtttgttaggcctgcaggaatgctgaaaatgtattaaatcagaattaaattataatcacaaagtacaactctaaaacctcccacaaaaacctgctttgaaactttaatctagccttttgtttttatgcatgtgccaataaaaactaaacaaatggtctggcattttacttgtcttaattcaaaactcaatcgtaattctactcagagctgaaaaatctcacaaatctatacaacaatttcacacaattcgggaaccgtctttttgcctgaatgcccccatacaaattttaagtatcttataacttaaccccaaacctcgatgctatagccaataaacccaattgagaggtgcttaagtaataaaaataaacacttgtgttaggtgaagggactaggtgtctatgaggacagaagaaacaaattcttaatttctatgaacagaactaaattttatatacatctctcaaaggtacatgagaaaggtgaatcaaactttacctaaaaagatcatcagcaagagactcttcttttgcatgttgattttgtacctgtcaaaattaacataatttcaaacatttgctcagtggtgaatatatagttaatgaattgctatagtgataggtcactgtcatcttagagatttccacatcctggaggtcaccacatctgagttcttgcctctacaatatttcattcaactgatcctctatattttcaatccatgctaagattattacaaaagagctctaactaaacagctttctcccacccatctccactcaaagacaaccaatagtatattgctagcttgctgagtttttaaacactctttccagcaaaacccttttactaaatgagatttcagtgcttgggggtcagaccactgatgagactaagagggcaacatttaccccaccttcaactagagcagctccacagttaaagaggctcctgtgttcttggtcccacatcagggcttagaagctgctgctaaattacctctcctctgaagtccttttaaatacaaactcactaaacttctacagcaccttacagagtcagaatcaaaaactccctgtgctgagtgcatcttcctaaagtctagctatgcccttatcatatgcaatttgaaacccttcgtgacttctcccacctaccaaggaaaacacaagcccttgcatttgacccgctgaaatgtgcaaggctcttcataacctggttccattttactttcctaatcacttctcagcctcctcttcgtggactctgtatgccggttaaaactgaatcacacaaaaaagaaaaaagcaaaaccaaaacaaaaccccagaatcatctcctaataaatatcctgtgaccctctatctgcttttgttcatatttctccctctgccaaggaagttaattcctttttttccctcttcccacatgtaaccatctttaaaggtacattcattcaatacttatttagtgcctactatgtttcaaggaacatgttcttcccctctttagcaaaggcttcctgatccccttcttctaaaaataatgcctgctgtgaagaactctcccaaaacttcagctacagaattcccaggatgcttatcaatttctaccttctgttataattatttatatttgtaccctatcctctctaaaagaccagaagttccttaaatacagatagagtaagtcctgacttaatgtttttgatatttcttggaaactgcaactgtaagtgagatgacatacagcagttccttgaatcatgttgttttgttgtaataatgagaaaaaatattggttatgtaattttgcttaaagttgcagtttccaaaaacctactgacaatgttaaggacttactgtgtttatttttactgttactaatttacatttgaatgcttccagatactatcttaaactctctctctctctctatatgtgtgtgtgtgtatatatatatatgaaatctcacttaatcttcatgtaacttcattactattatactattatctcagttttaaccaatgaggtaacagagacttaggttaggtaaacctgcagaagataggggaactcagatggaatagctgggatttgaccaggtctaccttattaagagcaccagctcttaacgaggctgcctcagggcttctgaatctctagagcaagcctacaagagtgacttgcagggattcgatcttacagactgatttttctatcatatagtgaaacaaaattacatcttatcttttcatattttctaatagggatagcaaaacataaatgggaagacatcattttaataaaacagctgtcaaaataactactggcaacatttttctaaacattcttagaggttgcctggggaataaagttgtagcatagtaaggaaaaaccactgaggagaaagcagttttatttcatatatttcagtaaaaacatataaaatagtattaagaaacagaaatgcctcatattactggcatttttcagaggtctgagataactactactcacagtctttcaaattcaaatcaggttggatacagttcaaataatttttatgtttgatgtacacaatgaaaatatcctaaattcaagggaacttcaggaactgacgcagtgattatgaaaatcaagactggtgggtctgcagcagaggtagagaaagaagggatgaaaaagaaaaatagggagggaatatagaaaaagaatagctgcagcaaacagggaaatgagatggcagtacagaacatttacataaataagcagtagccatgcagcaaaagcaagtcaagtctgttatagagtaagtcctaccaatagcaactaaaatgattctagcaaaaagagaagtgatttggtgaaatcatctagaacacagtccatctaattcctaatgaaataagcaaaaaaaaaatagaaaaaagtcagcagctgtatgatgtatcatcattctctcaacttctcccatctaaaattaatcaaacaaaactcgacagtgttaattaatcaaggagaagagtttaagccatgccatacgcttaaaaagtgcagctgtaaaaagaaccaaatgattctgatgcagctgattcctaatactgtctcaatccattaaaagtgctacacaactggtcaaacctgaggattcttactaatgccccaaatttggggaaaaggtaacctgaacagggaaaacaactgccagtgggctgctgggaagggactaatggtgtagaaggtaaagaagcagggctgacactgaccaaacacataggctccaaggatccctaacaaattaggtaaacaacctaataatgctaggttattctcttttatatagggcacactccctggtataggacatttaattaaaatcccaggagacagctagcccaagctgcacacagctccagctgagcctttcctctcccagattcaatgtcttcagacaacagaaactagatgggatatgccatgtgccactgactgtttcagcataatgccatactgacagtgaggcatgagggaattctgttctttaatttttattttatttattattattatttttgagatgtggccttgctctgtcaccaaggctgaagtgcaggggctcaatcatggctcactgcaaccttaacctcccaggctcaagcaatcttcccacctcagcctcctgagtagctgggactatgggcacatgcactaccatgacccgctaatttgttgtgtttttttgtttgtttgtttaattttcatttatttatttttttgtagagacagggtctcaagatgttgtgcaggctactcttaactcccgggttcaagtgatcctcctgctcccaaagtgctggggttatagtcatgagccacaccattgtgcctggctgaattctgttcttatgggcaagacaagaatgttagaagtaattttgattatactgaatttctgtctcacaaactggcttctgaatgtaatccctgcatgagatggcatatgatcctttatgtagcaaacagaatatctggaaaagacatttccctttactcaagtgaaggcaaaaaacagaaaagctactccatctactagaggaaaaaaaaaaaaagggatattggaacagaacatgcaaaaaacagataaagaacctaatctgcaggaaataataatccacgaataaaaagtaaaatagaaacatgaaagcaatgaaataatgacaaaaaatcagataatagaacaatgaaatgaaaaaagaacaaatgctaagtaaaagaaccataataacagcctttcagaattaaattagaaatagctaacacttcccactgttataaatgatttatatgtagtatctgatttaatcctcatatgtctgtgaaataaaggtactattattattctcattctgcacagatggaagcagagacattaagtaatttgcctaaggtcacatacttggtgagaaacattatagacacacctgaaatgtaaaattttgatacagtgaaagagcctaagaaaaccacagtgaatgcagaaaaaatagatgtggacgacaaaggtaatccaatgaaaggatagttatgtcttaaatgtcttatagagagcccagcaaatataaaatatttaaaatatataatagaaaaaagttccttgagaaagagaattacacctgcaaatcaaaacagcatactatatgtcaggaaaaactaatggagaatgatcaacactgagatgtattctgagtgttactggctttcgagcttaagaaagatgactggtcatgcatgcaagtcacctaaaaagggaaaaacaggactggcataaggtaagggaggctaggtgggaggaagtactaataatgtcctcacttttcactgtagcgagccaacaaataattgtatgtgaagttaatatgaagtttaaaactacccattccgacttacagtgatttttatagttttcctccttaatattagacagatctcacaaaataaaatatcttggagggaagaaacatttatagaaattcagcaatgccttcagtttaacttcctcctatcaatgtctctctcttccttcccagtctgtccctgcctctcactactcctcaatgaagagatgtctggaatattgttcacttaactgtttaaataggtaatttctgggctttaggttttcacatcttcattctttgtgtactgccataattctgtggaatgcacatgttacaaaataagccaattattctttcaaaaaagaaaaggagaaaggatgtgatttccattctttcattttttaaaaataagtatcctgagtgaccttaacaactctactttcataagtgactttcctaaataacccttattttaaaataactgagaaaaaagcacttttaaaagtgaattacactatacccactataaagcaaaataaggaaccctgagaggttagcaaggaccacagtcagcttttgccttgccctatgagtatctgcaagtcatgaaaaacctgaactctgctttaatgtctatacggggtatgagtgatacgaaagaaaacccaagatgttgactttaataaaagacccagcactaaaagaagaaagagaaataaaccttacaacacagaaggagctaggaaagaaacttgcccatcttcattctggcacttagtgaaggaaataaataaaaatctcatttgaagtttctaatgataagccagccttcattcactccagcttctggtccaaatattaatacatactaactgtctgggtgattcaaagaatcacaaggagagattttaatttgaagtggtctcatattggtagaagactcgaagatagaaaacgtatcttttctagaggaaatacatctgaacttaatactcaagaaaaccctacagatcgagttacaaagaaaacaatcagctcatattcaaaaatcacaaagcacaaacttgaaaacaaggtacataagagcagaaaacagatcaaacattttaggtaatggtatcattaggcaaataatataaaaggggaagcttgaaaaacagcaaggaacaagaagatttagaaagaaataaaacagacttccagtaatgaaaaaataaatgaacggatgcaatgccaactagagttgaagacagtagtagtaaatcggaagatgatctgcagcagttgccaaaaatataacccagggaaacaaagaaatgaaatacacaggaaagacaaatggaaaagaaaatttaacttacgttaagttggaattccagaaggagataatggggaaaacagtaaaaaggtaactaatattcaagagaatgaataagaaattttcagaattgttaaaacacaatccccagatttaaaaaggccagtcccttgacatacatttaagtgatatatttgtaatatcctccacattcttttagtttcccttaaatttttgtggcttttatctcccccttttcattaggatgtaaactgaatttcttaggtctcacctttttttttttttttaacaaaaataaatttagtattcttttaaagaagtgttatggaagggtatagattaatgctctgtaactcaggaatgctcctgaatgaatgactttatgtcacttattttaatttggttttaagaagaatttgcttgaaggccaccataatggaccaaagtgcaatttaagcaagtttctgggcctcacttcctactaacctccatttcctgccttagccactcttctagttctgtattctttcgagcatgatgagctattagatctgatcctccaatgatgtgtggaagttttcctgctccaggatatgtgacctattgaataataaaagtagtacagtaaatcatattaacaaacaaaaatgaccatttttttaaaaagattaaaaagcaaagatggtaaatcatgcataagtgccaaagatgtttatattctacaaataaaagtgagagcagtaactctgttctaaacccatctgtttttgcccttcttttatagctattactatatacagatctggacatgtcatgggatttatgtattaaaaataatttaacacttttcatttggagtttttattttaaaatggccttaccttatcatttaacaattaaagcaactcaagatgaacacaaacactacaattcaaagcactgtattttgttctaatgacttcaaagcttaagccctttctaatattgatgaaaatttaaatctttttcaaaactttccagttcacagagtccaagcaggagatgttggggatgccaacaatttatacttctaattgatattttaattgtttactagtaaagaggtgctttaagaaaagaaaattccatgtgaaaatgcccatcaagatcattgttaatacttgttattagttaataacattgttaatagtaacagttccttaatatttgtaacatgcttttaaaattccaatatatgaagtagaaagagaattttaaatttattttcacccctaagcagtattttaaaagtttaaaaaacgctatgtcattgatttggagggttttttgtttgttttgagacagggtctcactctgtcacctaggctggagagtgcagtgtgaggagagagaaaatcacctggtgaccatggaacaggccccagagacaaaacttcttctctaagcaatttagaagggggcaaagaccaaccggtgaccatcaaacaggctaactggaggcaaaactccttatctgggtaatttagaagtaatcaaacttccctagtatctaaagtcggcttctgattccaggcctctttcaacttttataagtaactaaaatttttatacatctctggaatgccatggtgaaactcattttacaatcccaagctcccaccttaaggtccataaatgctcctaaggacaatccgccacagtgtgctcagtcctctcgctgaggcacccctctgcattcttctgcagtgttcttcctttctaataaactttccttttccaaatctatactgttgtcggtaaattcttttcaccaacccgcaagttgaccacttcctggtgctggggctctgatacctggcccggcacagtggtgtaatcttggctcactgcaacctccgcctcctgggctcaaatgatccttcaacttcagcctcctgagtacctgggactacaggcagacatcaccatgcctagctaatttttatatatttttttgtagagttagggtttcaccatattgcccaggctggtctcgaactcctgggttcaagccatccacctgccttggcctcccaaagtgctgacattacaggtgtgagcgaccaggcccagcatgatttggagatgtaaagaactcagacaaattcctgcattaatatcaatccagttaaacatcttcctatagaaattttggattggatttcttctgtagtttcagaacagattacttggttaaggatagcagtatttttaaacattttaagtatttccaaaccactttccagagattcatattacttcatacttcttcagttgttaataaaccactctgtgccagtagtaaacattactgctgtttctttgtaaaactataaaaaaagtcttttgaattttgatttaatgagatcttataacacaatattaaacatgaagtaaccatgcagtaagaatgcctttgtgctattcatgagcctcagatatagggtgagaaaaagtggtgttaaacaaaaaggtatagtggtgccatttaagtggaagatatttccatcttctgctctaagtagaagagattcttcccatcaaatggagttcagaaccctttaggtactattacagaaggcaaaaaactaatttaactgtgaaatgttaatagtaaatgctcacagtagagagaaaaatctctactacctcacagtcatggcaagatcatgttatagaggaaagcagttctccacaaaaattacttttgagtaattactatactctgatcaaatggataagtaaaggctagcagtcagaagtaggtctggagcaagaagcaaatgtaagacaacaaaagaatacctactggatagaagtctttttttaaccattactgataaaataagtatcagttccttaatgagcagaaactcaggtctgatgatcatactcagcatatatatttatattgtgttttatatgtaaatatagactatagtttgaattactgaatatgcttagttattttaaatacattttaatcttcataaagtcctgagctaaagaacctcctcaagtagttgtagaccaatattagactaacagagaagatcctgtgattatcaacaaaaacttcctgcttaaggtagagaaaaccaggtaaacagcaacctctaaagaattcaatcttgatgaaatctatttcattctaggtgttcaatatattcattaactgtaagttcatatccttcctagaggaattttttaaagcattttaagcagaagaagtatcagttttcaacataaactgcttttatctttgtttagcatcactggtatctctaaaaacatttcaaacactgacctcttgtgatacagttgaaatacctacctttttgaatttcttgaaattttttagttgaccataatcatcatttatgccagatggatttctggaagtagagtttttaatcaccagtgatctaaattcagtcaataacagcttttttggaagcatctcactatcatcctgaagtttgtcattgttcttaaatggggttaagatggataggtaagaaagagaagaaataacaaagaaaagtcacttgtcatttgggaatctatagaaaaaagttcaaatacctgaaaaaatagtaaaaatgttttatttcttgtacctgaactttgtatttggaatcaaattgtagctaattcaagataagaaaattacttactcaaatgctctataaactttggaaacatttataacatactcatctgtgacagaaggctaaaaactgtgaagcatttttaacctagtagttattctaataaatatcatctcagtaaacaatttacctccagatatatatcttattgacacaaaatctcagcactgtttgcttttcattaaaattgtacactgagattataatatatcctgttctacaggtcctcatctacttttcttaaacttttgggattctcaagagtttgtatcttttattattcttaacacctcaaaaaagtcaatcatcagttctggacatactatctcattaattgacaagccatttttaattcaagattaatagctgttaaatttgcctcaagagtccttcctgttatctttcaattgctggatgagattcttggcttcgtgtcatttactattaactagtcagttacacatcaacattattacagctgcttaaggttgacatcttagttcttttaactgctgtaactacataattaatatgcaagttgctaataggtctaagataaaagcagtcaaaaagaaaaaaaaaggggaaagtcagaaaaaaaggttcatctgatagtgacagaatgtaatcagcacattattaagaacagcctaaacttttagagtttacaaatatttcccatccattactcttatctgatataaatcctgctagaaaagcatcaacctcattttatagagtatttgaggttcttaaatgtgaaaatgacttgttcaaggccacatacctaaggagcagaaggcagggaattacaccctggcttctctctatactcttttcactgcatcatggttataatacgatctatccaggccgtgcatggtggctcaagcctgtaatcccagcactttgtgaggccaaggcgggcagatcacctgaggtcgggagttccagaccagcctgaccaacatagagaaaccccgtctctattaaaaattcaaaattagtcgggcgtggtggcacatgcctgtagtcctagctactcgggaggctgagggaggagaatagcttaaacccaggaggctgaggttgcggtgagccgagatcacaccattgcattccagcctgggcaacaagagcgagattccgtctcaaaataaataaataaacaaataaataaaataataataataataataccatgatcaatccatttcaaggcacaatcatgaagtaagccataattaggaaagagaaataatcctaagaatgtaaaatcacaaaaattgatgagatgacagtccccgtaagccaaatctgtataaaaattaataaaacgtttctcacagatatttctttagctgaccatagtgagtcttccttgagttcacgtttcttcccaatttcattttcttgctaaagaaataaaataaaaaatactgttcataggagtaataaaatggtatgtttctatcacttcttggccttttgaataagatgaagtgtaaaatggttcctttctaaaaacttaagagatattcatgttatgtatgaccaggcatttggctttcaactgtctttccaaaagaaattatgagatgaaaatatatattgaaagagatactgcagtatcaggacaaagaattggaagcgatctaaatccatataaatcacatgcttagagaatatttaacaatatgggaaaatgattataagtaaatttaaaaaatgactacaaaattgcactaacagtctgcaaaataaaatggaaagagaaaataccaaaatattaaccatggttgtctgtagatggtaggattatcaacaaactgtctgttttattttctacatgtctgtacgatcgtgtattacttttaaaatcaaaaaagaaacattttaaaagaattcaagtttacaatagtatcttaaatcatacttaaagaagaaacagttacttcaactgttcaagatatttgtctgcaataaaaatgaagactgccttgtatattagtcacagtatctttcacattaacatgtctggatcatgtcctagacggaacaatattacataaatgggtaatgatttcagtaaaaactacaattctcttggatgcaaagtggggcacataacattttacgtcacattttcagtaatacagcagtaagtcttaaaagttttaaaaatgaagttggaaacggcagaaaaacaaatgtactttgtgcttccccacagagtaaagaggatattttaatcaatagaattaaatgtatgtttcaagcctatcaagtgccattttacttaggcacatatcatttacagaaagttgttatcacaatcagaacattttactccctttatacataatcagaatacaaactccttttatgtaccttctccccatcctgccctactctctcaaagttgctcttcctcttgagcaagttttgattttccaactcagagaatcatacgacctacctagatactcagaatataagcttggaaattatcttatattctttcctatctatttatttcccatataagtaaaccaccaagtcttggggattctacctcaatgcctatcaaacttctcttctcaaactgcctttcatggcagatgcccaatgcctacagtaatggaataactgagtgaattacacagtgaaagctaacaaaaggatcagtcagaagagcatggcagacctgtgtttaagtccgagttgtcaaacctagctatgtgaccttggcaagttacttaaaaactcccactatcagtttccacacatgttcaataggatattaattgctgcattgtagggttgctgtaaatataataaaagtatccaataagtggtagctattactacagggtactggaaaatgctgtagttttaagaatttactactgggtattgaaaaaatgctatataaaaatgcttgacttgagaaaggagagtacaatgaagtgaagaggaaatatactatagacacagtgggtgctgttaaggagaagaatgttaaggatcttgagtcagttttgcattttatagagactgggaaactgaaagtaaggccaagactcaggcacagctatcattcgtataaggataaagtcctaggaggaatattaagctaatagttttccatttcagctgacaggaaatcttacagacatgctataatctaaatttagatccaaaaacagagaaatgacagttctaccatcaacatctattggaaagtgcctttctgaaatatagctagggattccaacaccaaagagaagtatcacattttttgccttcaaaaaatcgccaaaaaaatgtttaaatgaaaggattaagaagtatttttctctgacagtcacttctgtagctaaaaaaattaagcaccaattcctttaatccatgagattaacatggactttcagacaaattcttaaaataacaaaaataaaataatttaaaacaaccccacattgagtaaggttgatggattttatcaatgtcaatttcctggttgtgatactgtactgtagttatgcaagctgtaacaatcaggggaaattagataaagggttcgctgcatgtggacaaacaattgtctcaaacagtttttaaaagtaaccttacattgaaaacagaaatacttttgtagctattacagattcttactaaaaatattatagtgctggaatacagtgatttaacttgtagtagtcatccctgtggtatccctgaggaactggttccatgacttcccatggacaccaaaatccatggatgctcaagtccctgataaaaaaaagcataaattttgcatataacctaggcacatcctctcatatactttaaatcatctctagaatacttacaatacctaatacaatgtaagtgctacgtaagtagttgttatattgcattgtttaggaaataataatttttaaaaagtttgtacatgtacagacgcattttttttttcccaaatactttcaatcacaggttggtaaaatcagaggatgtgggacccatggatacagagggccaactgtatctcaatgagagataccgcaattaaattgctattctttctccaaaagcctacaacaacatattttgtactgtaattttcatttagaatgtcatgaattctcaaacagtaaaataaaggaaaaatggaattatgctatagaatcatagggcaaaataaaataattatatttcctcatatcgttatacctcatataaaccttacatattaaatgaaagtttctttcggtctatgaaagactgtttgatggctcccatgtcaagggtgtatagtgctcagttcttgtctttccctgtctgtgctctaatgcccagtgccctgagtgacataagccctgggagaatgtgcagtgaaagtaggtcttcaggaagattaattagcagtcatccaggatgagccaaggagggctgttacagactaaaaccacaaccatttccagatagatttgtggccaccatagcagtagactaatctgggatggaatttaagggaaaaaaagtggggtgggggtagctacttaaaaaaaattaaagtcactttgggaggccgaagtgggtggatcacgaggtcaggagattgagatcatcctggctaacacagcgaaaccccatctctactataagtacaaaaaattagccaggcgtggtggcgggcgcctgtagtcccagctactagggatgctgaggcaggagaatggcgtgaacccgggaggcggagcttgcagtgagcggagatcacgccactgaactccagcctgggtgacagagcaagactctgtctcaaaaaaaaaaaaaaaaaaaagattaaagcatgtactaggacaagaagactaaagaaaataacatgtcagagaaaatcagaggagaagagagcacagcaagggaaatgtatttccaaaggtgtggccaaagtaatgtaaaaagtgcctaactttctaaacacttacatgtaatattaagtaacctgaatacagattctgaaaagtctggaactaaagtaacaatgtaaatccataataccaacagaataaagatagctttataaacatatgtaaatgtattaaacttagcaaatgatgtcttggatttcaacaaatgtcacattaaactaatttacctagctctccaccatagtaggaattgcgacagaagtgacttatagaacatacaaatctcttgtttcacttagtgcatctgtgaaatgagagtagtcttaaatccttcacaataaaaaaaaaacctctgtctctgaacttctcactctggctgcaaaatggaatccgataattcaacattcattctctcttttttccttaaatgcaactctttatcagggacagcaatgtgccaagtttaaaacatttccagactcttctagattgaggatagagagtggctaaattatttccaattctggccaataacaaaagctattaagttgggtttctgagaaagctccttagaaaacagggaggaattcagctggaaaggcctttacctgtcccctcatcatcacattctccctccctggaaagtagacttgatggctggaggtatcctctcaaagagcagaaagacagacacctagtaaattaataccatgggaagcagctctgattatctacttccaggacacttttataggggaaaaaagatcctattttacggaagccactgattttagaatttttaaaaatatcaaaggaattcttagctaacccaatgagggaacttatcctgggaaggaaaatcagatatactgaatgaaaatctctggggctctggcctgggaatctatattttagaaaagcttaccagctgactccaatgcagctggtccacagaagggcatttaggatcactcagaagaagtaacaaataatggggattcccttgcctatatgaagataacaatacacaggccaaataggacataggttctgttttttgaatagtagttgtagatttataaggtccttgatacacactaggttctcaactgcttagctaataaactataacttccgttcacttaatcctatcctttcgcctattcctgtccttattctgcaggtgttactggagaggatgaccacagccatgaatgagtggagctaatgaatccacattggagatcagaatattaaagttttacttcatcaggtctgtgctctcatctaaagagctaacaaatctacagataagtcaacttactgatgtatacaaaaaagaaaataatctcaggtgttttcatagatcaaagtgggtaagacaaattatcaacagtcatgaaaatagacaaggacattacaaaacctaaatgaaaatgaaaattcctagtgatgttatatcctaaaaatttattgagtagatactttgttttactaacttcatctttctgtgcctgtttcttatactgaagcatctcctacacttatcatcatagccaaatgtcttttataatagtacagcctaatttggaaatctagtaaaacaatctcatatgaaagtttaatttgtggtcatttattttacactactgaagaatcactgtacttttaacatttaccatttaccttatcaaccaacaaatttctatagtactgagtgttaaagacattaatggatgctcatactgtcaatacaaaatcgaaagtacctgttagcattctaagcttctatgtactatacctctcatttaaaatgttacttacagatattttgctactttctggtactgcttcatcactgaaagtgtcatttgtttctatatccatccttggcctttttctaacattgacatcttcctcctgtttttgaactttcacatcaatttctaactctggttttgtgtccttgaataactgttccaatacttcatcttctatggccacatcatccatttccctttttttatttgatcttagcttttctgcagcatgagatttactggcagaatttttcacaatagattttaaatctgtatctgtaaataagttattgtctgagtttgtgtccacaggctcattctcagatagatgctgctccttatttttccacaatgagggtgtagcaggttgtgtttgttctaaaagagaacaagacgtttctattcttgctgatttgcatgaagacatttcttgattttcttcatccctttcccttagatttaaaaaaaaagaagaaaacaaaacaagaaaatgaacacagctaagtaaccatttagtttggcaatattcatcactccctccatttagttcacaatgtactcttgattttattaacaatattactggaaatcaacaaatagacctttgaaaacagtgcagaactcacatacattctgctgttttgatagaactgacggaccctgtggctaaagcagtacggtgatctctatcttctctgcttaagttgcattagttgataaattacaggaaaaggtagaaaaatataaaaatacaaagaaactgttgccaagagacagcaacttactttataacgtagtaaggttgtgggcagggaaaactgccctgggaatacaatctgatgggttaatgagagatggattcaagacagtaagtcagagtgactaaatctacaatacggtactgactgtatactgcaaatgctatgtgaatatatcactaaaagtttcctatacaatactgtatcattcattcaataaataccaaacactttatgcaaactgtactaagcccatagaggacacaaagacctgggactctgttctccaggagtttattggattcatgttgaacaagaacagtcaacccaatgttctattaacactaatttaatgccaaggtactggacaaaccaaccaatcgagaggtttttgtaataatttaggtggtcagagtttgaacctggcaatagatggaaatggagggattgacagacactgaaaataacaatcaataacactgatttcaggagccagaggacaagagtcaaaaattgtaacaacataagctattttactaaaaaaaaaaaacaaaaccacatttggtgagaggacagaaaaagtttttaggtctattactggggaaacagcatgaaacccctgtggaaaagaagtaaagtttaaaggaaaagttagggccacatatgttgattgtcagtaataaagtctcaaaacctgaaggtagagtataaagagcagtacggggaagaaaagaagtcctccaaagttcatacagaaatgggagaaataacatcatcttttctgagaagcttaacgggacggcacaagaaaaaaggcagcagtagctagaggaagaaaccaggtcaagagaaggttttcaaaaataaaggtgagattgaacttttgaaaacagaagaaaaaaatctgggatgatcaatatattcaaaatatggaaattgagaaaataattgatggaatatggtcctagagggagtgagagcggttctcaaggaaaaccagcagaaatgtgattttagagctgagacagggggttagttcttattgaagagaattgcggcaagtaaaataacacgtaagtacatacatagaaggagatgaaggagaaactgtctagtggctctagtgaaggagatcagggacatttctgagagggaaagcggtcaaaaagctgcagcagcagaagcatacttaatcagaacagactaaagacaataccattctacaacagtataaaaaactttcatttttttttcagagacatgagagaagttatcaaaaacagacctttttttggtagacggctgaaagtagtttctgatggagttggtctgctgctgctgagaagccctatctttacttttatttatacttggcaatttagttggtgaaagctgatagtttgggattctcatcttagccaaagtatttgataccatactattattattagagcttgttttgcaggactcctttacagtgggtgcatcttgtgaaagcattctgaatttttgttccattttggagactttgatttcttttggcctttcactcaaatccctgtagaaaaagaaaagaatgcaaggtaaataatcaagtttacagcaactttaatagagaaacaaagatcgttaaatagttctaacgtaatataaccttagaagataatttttagacaaaaatacactgaatatattttaccatcccaagaaagcaactcctttattacctaagcatcctgtggaaggatgataccttactcttcttcaccccctacagcacatattgttgctccactatagacgactgacaaacacacacagaataccaacttagcatagcctattataagttaaactaggtgataatcctaggcaatttctgttttgtttaaaaattttaaattattcccacgtaaaatcactattatggtactttcattattatttattattatattattatagtacctttttattaaaaatggaaaatcagaataaaatcacatataagatattcaggtcactgtaaatgaactgatatcattatttcagccagatggcagactcgagaatagaacagaactttagattaccagaaaaatattttcaacatacatgcacagagtatacttttatatactttttacttttacaaagtatggttaaattagacactgcctttgctattcttattttacagaaaaaaaaaaaacaaaaacaagaggtcaggctgtcattcaagcaacttccaaaaccttaacaatttctcttgaaaaagttaaatctggcctcaatatgagtgtagcaaaaattaaaataaataaggtttaatacagtgatatcttaagtatcttaatatgaacacttcattatgtcatatttaaaataaaaaacatacggttgtaaatagaaaataacaaataatataaaagtgctaaccccttccattaaaaacaaaacaaaacaaaatccctcttcagataaagaaccatagaaaaactatctttatggacaactattaactatttaaatagctaggtagacacatataaagtatcttcaaaattacaagtaacattcaaatataggcaacatcacgcaatacaaatatatgtatttcaaacttatctcaccagttacaaataagttgaacaattctttccagtcatccatgtacatttgcaaggaataaaaaaactatcctaagacaggagttgccaaactacagcctgtaggccaaatctgatctgccacttatttttataaacacagttattagaacacaacactttcaattacagtcacagacactatataatgatatttctgtcaacaatggactgcaacatatgatgctggtcccataagattataaaggagctgaaaaattgctatcacctattgacagcacagtgcaacctattaagtgtctatggtgatgttgatgtaaacaaacctatgctgccaattgtataaaagtatagcacaacagcacatacaattcggtacaatacataatacttgataatgataataaatgactatgttactggttaatgtatttactatattatactttttatcattagaatgtactccttcttataaaaaaaataactttaaaacagtctcaggcagtcccttcaggagggattccagaagatgacattattatcataggagatgacagctccatgtgtgttagtgccccagaagactttccagtgggacaggatgtggcaatgactgcgatgatcctaactctgtgcaggcctaggctaacatgtatgtttatgtctttgtttttaacaaaagtttaaaaagtaaaacaaaatttaaaaatttgaaaacagaaaaccttatcgaataatatgaagaaaatatttttgcacagctatacaatgttttaaatgttttaagctaggtattattaaagtttacagagtacaaaagttacagtaagctaaggttaatttattattgaagatttttttgcatataaatttagtgtagtctaaatgtagtgctaataaggcaacaatcatgtacagtaatgtcctaggctttcacattcacttaccactcactcattgacttacccagaacagcttccagtcctacaagctccattcacggtaagtgtcttatacaggtataccattttttatcttttatacaatattttttctgtaccttttctatgtttagatacacaaatacttcccattgtgttacaattgcctacagtatcagtacagtaacatgccatataagtgtgtagcctaggagaaatagtctataccagcagttcccatcctttttggcaaccaggaccagcttcgtggtgaggttccaggtttgcgggcagaggggggaatggttttggataattcaagcatatttattatgtactttatttctattattattacgttgtaatatataatgaaaaaattatacaactcaccataatgtagaatcagtgagagccttaagctcgttttcctgcaactagtcagtcccatctgagggtgatgggagacagtgacagatcatcaggcattagattatcataagaacctagatccctcacatgcacagctcacaatagggtttgtgctcctatgagaatctaatgctaccgctgatctgacaggaggtggagctcaggcggtaatgcaagcaatgggagcagctgcaaataaagatgaagctttgctagcttgcccgctgatcacctactgctgtgtggcctggttcctaacaggtgatggactgataccgtggctgagagataaggaacccctgggctatctatactatacagtacgctataccatgtaggtttatgtcaacacactgttcgatgttcacacaatgccaaaattgtgtaaggaagcatttcttggaaagtatccttgtctttaagagactacgtattgtctcttgacaatgactacatatcgtctatggccactttcatgctacagtggcagagtggaggagctgggacagagatcaacagtcttcaaagccgaaaataactactcgccgctcctttacagaaaacctgctgacccttgtcctaagatatcattttccctggtatcccattcttccatgctttctctctcaagagacaacctgataaagggcattacttcctgaatatactattaatttattgatagaataataacaatagtacggtaatgaagaagctttaccatgtatctgcttgctctgattctgtgtcagctacgtatgttgtagtgttcactggggcgcttggcattagtttttcatcaactgacacgccttgtgaaaggcttggtcctggagttgttgtctttaatcctgtaaatcacacaagtagaaagaaagaatcacaactgctagatagaagatgaacatctggtcacttaaaattgttagactataccatgctgaggggattaactagggaatactgcacatggttttctccaatgagtggtaccaacaaacacaaaacagtctataagcagcctgcgggcatctatgacgggcttatctaaaccaaatcattttaaagccacatcagatactttgtgctgaagtcttatcaactgaaagaaaaataaaataagcaaattctaattcaaattatgttttaagtcagtgggccaaaaaattacatttattcccccacagaaagtgtatacaccctaccatctatagaaatcagaattagtgagttttattttcataaggaatacattatttgaaacaaatcatgtaaaaccatcttagacataaacttctggctactccagaaaaccataatgattacctcatctttttacttaccagaagaacaacttagttcaagtgctgctcttctggaatactttttttgaatctcccacactgaattaagtgctctccaattctccttccataccaccacgcaaatcattctaataacaattcaagccaggtgcagtggttcacgcctgttatcccagcactttggaaggctgaggcaggaggatcacttgagcccaggagtttgagcccagcctgggcaacactgggagaccccatctctacaaaaattaaaaaaaacttgccaggcatggtggcacacacctgcagtccaagctactcaggaggctaaagtgggaggatcacttgagcccaggaggtcaaggctgcagtgagcagtgattgtgccatggcactccagcctaagaccctatctcaaaaaacaacaacaaaaaagcaataaacaaaattcacttatgactagctgagtgacctgtgtcaagttatttaacttctctatgcttccctttcctcatctataaaatgagaataattataacatctgcctcacaaagttgtttggagggtaaaatagcccctagaaaaatgcttggaacatagtaagcactgtgccagcattagctgttatcattatcatcacttgtttacttgctactttcccttgttagactggtgtatccttgagaataaggactaagtcttgtgtatttctgtatcaccagtacctagagcaatatttggtatagagtagatgtaaaaaaagtttacactattaactgaaaaaaattttaagttgatatttactaaacacctaagctaaattatcattctgctaggtccttgtgacacaggatgtgcttaatatttactactaattctaaattcagatatttaaatgacttccgccactttctctatgtgacctctagaagctcactggcatttcctttaagacacatatctctagaattcattttcagctgcacataagtttggaaagagtaaaaattataaatgttcatatcatcactgaataatttaatgtaggctcggtgaggtggctcgctgctgctcagcactttgggaggatgaggcaagaggactgcttgaggccaggagttaagagaccaacctggtcaacatagtgagacttcatctcaacaaaaaaatttaaaaattagctgggcatggtggtgcacacctatagtcccagctactcaggagggtgaggcaggaggattgcttgggccgaggagttcaaggctgcgtgagttatgatcatgccactgtactccagcctgggtgacagagcaagactttatgaaataataataataataataagctaatgacccaaaataactggtgtttgttaacagattacttacaattttctccttgttaaaaataccataagggcaggaacttggtctcatctattcacctctttatttcaagtgcttgccataatacaggtatataacaaatgttcaataagtatttgttgaataacaaaagagtgaatataaaaacaaaggaaggaggagagaaaagggagactcattcactctgttcccccaaagttggttgtgctataaaattattttattatcagaggactatgacttggaacccacctaaacctacctacgaaaatatgcaagaagtaatactacatacagtgtactttttaattcactctcatgactttgtttctgtaggaaataatacatcagaaaaaagcaccagtctggtagtcagaaaaccaaattttagaactggcttggccatgaagtagttatgtaccttaacttttctcagccttggtataccttatcttttaatagaacgattagatgatctctaaggccctttcagctataaacacaatttcaacagtgggtgacaatattttgttgctccacactggaaaacataatcttgtgtaccaatagcttagttcaattacgcaaaatatttatacctattacaaacaagtaccgtgcttgctgctgttaggggatcccaaattagtaagagcctacaatctactcagtggctgaaagaggtgtggaaacaactggttatatccaaagtaggaagaaactccggctggaatgcaaaaaagctactgagcatagaaacagaataattacatctgacttggaggagttgggagtgaaaacaatttagaagagccttacgaaggaggtaatcatttgtagaatgagtcagattttgacgagcagtactgaacattctaggaatggaacatgatgttcaaggtgaggaagtgtgggaactataaaaaatatggcacacatattctgtagagaaactatgtaaaaaaggcgaggtcgggaggaggaaggctgcagctaaactactgaggactcagaagtctagacaaagggcttggagatttattctgtggataataagagctagttaaaatttttgagaaaagagaaggtaattgaatagtggcatagtgaaatattaactgtagagatgagtctggagtaaggaccattactagggcaattactaatacaaccagcactccagagagaaggatgtagagggttcaaacagggtactggctgtgagaaggggacagtcacagacctcttgagcagaagctgtagagtgagaatttcaggtcttggtgataaaatggaaaaggaagaataaaaaatgtccaaagtttccagtctgagtgcttcttctttttatataaaagaagactcctctctagttcatttcttctcaagactattctaatttagtggtttctagagtttgtataggaaacaggagcttaaaaatcaaacaaaaccaaccaaaaaactcagatgtctaggatgcatcccagaatgttctgaatcatggacaatgtacgtttgtattcagaattgtttctgaagcatatatctagttgagaattgattttctaaacagagaaacacaggacagtgaccccaaatgggtgctgagacaaggggagctactgacttagacctaatcaccgtttttatatgtttgttgtaattaaagtctaaaattactgatactgatcttttttctgtaagagaacagaaatctatcaacaaaataatatctacagcacctgctagttctaaaagttgagcatatttctagtagacaaggaagcagtagtttctccaagaatatggctctctttggcatccacatttaaaaagttcccttgccaagagcctgaagagttggtctttagctttttactttatggatgaattctgggaatttggtgaaaatattaatcatatcacgattccaccaaaataagtgatttggttatatttaaaacttcacaagaacttacgactgtgtgtatttgaaggttacctatgtacagacacaaacatatgtagtatactcaatgggacagggtagagatgtcagctgaataaacattcttatccaaataataaaatactagcctgtcaaattttatcagatgtctatgcttttgcatcagctcccaatcatccctacaccaccatttctcaaaacgtcacacattaaaatataagccatttgtactgcaatgtgatgtcgtaacagctttaagactcagcttgaaccaattacttgctatgtgacctccagctaatttcctctctgtccgtcagttccctcatctacgaaaagtagatgatgctcttccctctatcttataaggactgttttgcagattaaagtttgatgatggtaaagtgcttactctagtctctgcacactccagagacagcagttattattactatgcatggttactaacgatctacatacctaatagcttcctggtcattaggccgtaatggctaactccttccaaaatttagcttagcacattccttacttgtttaaaccaaggttgcagagcactcaggagatacacggactgactccatagttgccattcaatggactacagtgaatgatgctccccggagtgtgcaatctggtagtgctgttctctaacttgtctcttttagcccaagttcaatagctgctgatgaaataactacacaacaaatccagggagcaaataaatatataaggaatacagaatggatgctctgagagctaggcaaattagataaaagttagtagagagaataaatgtaaaaatctccaaggtaaaaaagcaagaagaaaagaaataaaccatttttacaacaacttactaaaaaatttttttaaaaactatggaaatgtgttttaactaataaaggggaaacagtgactgtctctgaatacattggctttcatgattaacactgagattattataatgcacattcttcatctcagtaaatggcaccaccatccacccagttacttatgctaggaaactaggagttgtttctaactgctccaccggaaagtcccaccaggtctagttctaaaatatatcctgaacctgttcatttttctgcatctctactattaccatgctggtccaaggcatcaggctctttcacatccagatttccacaatagcattctattcacatctcctcttacactgtcgacccttagaattctccacacaaacctaagagtgatctgttccttctacctggaattatccaccacccagatcctcacacagctgccttttcccatcattcaggacacatggctcaaatgtcacctcctgagactttccttgaatacctatctaaatagcctactaccatcactattacatacatcaccttgttttacctgtctttatacttggcttgatctgaacttaccatgtgtgtgtgtttggttactaaatcttgatcttcagaacataaagtttataataacaaggatctttcttattttatttaccacttcataacagtttctgctacatggcagccacaaatatttatggaatgaataaatgaaagtataaatggatgaattttaaaacatggtgaatatggtcacccctagcaagtatatgagtaacgtatatttagcttatcgatttacataataaagttgctaacgaatcaataaaataatgcttcaattacctgtactgggatggccctgaggatcacagtaattctttgtagtcatgaaaatcaccgccaatccaatttctgcttcaggaataggtctaagaccttgcctattagaataaaatagtttaagtatgataatatattaaaactagcaacttttattcagataatgtcaagataaagcaacctcttttttttcctcccaaataattttatggtatagacagaatttcaaatgcagagtactataatagcttactcgctggggcactgttacgttgacaagtctaccatcttttagtaactccattaacttcatctgtaaaataaggggctaaagaatatagatcttcccagttctaaaattctacaatttttggaataaaaagaatacagtactacccaaattaaacaacagaacaggcttttatggccaggcatggtggttcatgcctgtaatcccagcactttgggaggctgaggcgggtggatcacttgaggtcaggagtttgagaccagcctggccaacatggtaaaacctcatctctactaaaaatacaaaaattagctgggtgtagtggtgcacgcttgtaatcctagctactcaaaaggctgaggcaagagaatcgcctgaacttatgaggtggaggttgcagtaagctgagatcgcgccactgcactccagcctggatgacaaagcgagactccgtctcaaaaaaaaaaaattaaaaaaaatcaccacaggcttttacaaacaaatctacggatactatgagcctaagatgaaacttcaaagagaagaaaaaaagaagagagagaggaaggacggagagaagtagacagaactatacctaaggtatatctatacatgtgttacaacttttagtaaatcaaatcattttgccaaatttacaagtattaaggtatcttcacattaaaggaatcttatggtgaacctattttttgttgttctgtaaggtcaatgactgattttataaaaacaaaaatacaccatttaatatcatataaaaattacacctcaaattttaacaaacaactacaaaatgtcttcaatactcattgtaaagatttttttttttttttctgagacagagacttgctctttcacccaggctggagagcagtggtgcaaccatggctcactgcaacctctgcctcccaggttcaggcaattcttgtgccctgagcttcccaagtagctggaaccacaggcgcgcaccaacacacccagctaatttttgtatttttagtagagatggggtttcactacgctggccaggctggtatcgaactcctggcctcaagtgatccaccctcctcggcctcccaaagtgctgggattacaggcgtgaaccaccttgctcagtcaagatattttaaatggttagttcgtaaggtctttttgaaatgcttaatgtgtctttttgtgtgtactgagcttacttaaataggattcagttatacgtgcaattaaagtatcagactaaaaaaataaaatctaaaaaacctttataatcaagtgatcacatatacctacctgtaatttaggtaattcaaaactggtattttatttactaacttttgcaactataacttatactatgtgaattagttataaagaatggttacataaaatagaaacatttttaatacatatttaataatgctctacagaaattacatcacccttaatggagaaacactggaagcatttattttaaagtcaacagtgagataaatgtggccattttcaccacttctgttcaacactgctctggaggtcccagttggtatggaacaaagagacagaaaaaagaggtatcagagaaataacgattacaaaggagaatggaaacattccttatagatgataatgatttatagaaaagactatagataaattattaggaaaaaagaggagtctggcaagatggctggatataagatgattatctgaatgtcagctgaatttctttacagcagtagtgaactagaaaaggtaatttaagtgacaatatcattcatttataataatatcagagaatatgtactagctaggaataaatacagtaagatattcaagatctctctacagaaaatataaaattctattaagagatttcaagcaaacctaaataaatggggataccacattcaaggataaaaacaattaaaatttacataaatcgttaattctcaagttgccttgtagattcaatgcacttcctaatcaaaatccaaacaaactttaacaaaagatgattctaaatgtaaatgaaaaaataaagggccaagaatagccaggatgcttccgaagaagagcaaaaaaagacttgttctaccagctaggaggacttcatggaagttatactaattaagacaatgtggtattggtacaaagaaaggcagactgatgaatgaaaaagaataaagtcaaaaacacaaaagtgcatgtaactttggtataaaacagaattccagataagttaaaaacaaatgtcaaaaacaaaagatggtatcaaaatactagtaaaaaacataggtgagtatctttagcactgactaaaacagaaaagatttttactatatagcaggtcctcgaataacatcatttcattcagtgtcatttcattatgacatcggcaagaaaaaactgattcctaaccagggccgctgtctgtgtggaatttgcactctcccccagtgtccgtgtgggttttctgtgtgtactctgctttactaccacattccaaagatgtgcacattaggtgaactggtgtgtccaaattgtaccagtctgagtgagtgtgggtgggtgtgtcagtgtgccctgcaatggaatagtgtcctatccaaggttggttcccaccttgcaccctgaactgctgaataggctctggccacccacaactgtaaactggattctggatgacagttatttcacacaggagaaaactgggctaggggtaaccacgtaagttattttcaaagatctggctggtattttagatgacagattttttcaaacacttgctgtctgaaaaataactaaataattggtgaacaaaataaatgtgtattacgcataaatcaatgatgagcatgtgtcatggaccaaggattatgattcatccaattctgtgcaaggctggggaacaggtcaggaaagaaggaaaagcaggaggaaataaagagaaaataattaaattaataacaggaagagttaccaaatttgagctgagataccggaaaaaggtctcagcaagaacaaaaatcagggctgtattgttcccctagacttctaatcttctccaaaagacacttaatctttaccacagatttcctatactcacttctgacatctaatcaatacagccatggcaatcaccaatcacaatgttgccctgttgaagttcggtcaatagctggctttactggccactctgcttcatataattgctccttcattggcttgaactaagttaacaggtatcattttaagtgacagtctttctcaaaatataatactgcattccctccaaaaaacatattgtggccaggtgtggtggctcacacctatgatgccagcactttgggaggctgaggcaggcagatcacttcagctcaggagttcaagaccagcctgggcaacatggcaaaacccagtctctacaagaaataaagaaattagcagcaacgtggtggtgtacgcctgtagtcccagctacttgggaggctgaggcaggagaattgcttgagcctgggaagtggaggctgcagtgagccaagatcacaccattgcactccagcctggagtgaaaccatgtctcaacatccccccaccaaaaacccaaaaaaccatattgtaacaggggccaagtgtcacctcatgatcaaggcaccagggtctgagctacctggtactccagctacttttttttaacctcagggtgtcaatatgtgctgaaagtaaagagcctggactccagaatccaactgcctgggctcacatcctggccaccctgctcactgcctctgctatatgcaaacccccttctgcctcagttccctcatctgcacagtgaggaccacaacagtaaataatatataggttgaggattaaatgtttatacatacataaattcttagaccagaacctgctatgtaggataattttttttttaatgtattactgctgttgctctgcttggcacattctttgtctggctctttgaaaaactggtcataggtaagacattgcctaaaagaggccttctctgtttagaataagcttcttccccactgccgggttactgcttcctttatatacatgtgtaatgatttgtttacttgtctttctctgtctctgcctctagacagtaagctccagtgatggcagggactgtgactatcttgtttttcattatatttccagtgcctaaaacacaatggaactacagtaaatttgtgttgtagtaataagatagtatttttgttatatagtatatcttcttttttacagtagttaatatatctcaattaagtaaaatatttataggatagatgactaaaattttactttttatttcagcaagcctgtaagagaaaaaaagaaaatccccccatggtcagaaggactcctgggacaggaagaatgaatctttggtaggaagctggctgtggacttttcaggcatataaacactttagtcctcacctactttttgccacatgaagagcaatttagtcagaagactgccaagccatatatttctacaatacttactggcttcaacaatgctaagattattaatgcaaattaaagtctaagaaaaatccttcagttagctcttttacagtctccctccactctacaaacatcatttcaacctatctgactttttgtctgctttcccataatagcctatataaggataggaatgtttatatgtctttctaatgggtaataaccatcaaagggcaaatacatttcaacgctaggcaattgcagaaaaccttttaccgttgagttttaagtttctcaaatgcaacatattctgtaaaaaaacttaacactactttgttaatttacagaggtaaattctacaaattctattaaagtaacaaaaaagcataaaatatttttgagtaaaactgtcatgaataaagatattctatatctaatataccaagtcacaattaattttcaagtatactacactataaaaccttttattaattcttgtatcggccgggcgcagtagctcacgcctgtaatcccagcactttgggaggccgaggtgggtggatcatctcaggatgggagtttgagaccaggctggccaacatgttgaaaccccatctctactaaaaatacaaaaattagctgggtgtggtggtgcacacctgtagtcccagctactagagtggctgaggcagaggatcgtttgaacccagaaggcagaggttgcagtgagctaagattgtgccactgcactccagcctggacaacagagcaagaccctgtctcaaaaaaataaaaaataggccaggcacggtggctcatacctgtaatcccagcactttgggagactgaggcaggaggatcacctgaggtcaggagttcaagaccagcctggcctacatggcaaaaccctgtctctactaaaagtacaaaaattagctgggtgtggtggtgggtgcctataatcgcagctactcaggagactaaggcaggagaattgcttgaacccagaaggcagaagttgcagtgagccgagatcgtgccactgcactccagcctgggcaacaagagcaagactccgtctcaaaaaaaaaaaattcttgtatctacttttacattgttaggtgaaaagcaacaaaaaaggttaaacataaaatctcctacttgcagttttttactaataaagaataattctatacctttggagcatatccattattgactgaatccatttcttctgacagtcaggaattaaggtctgtgagtttgttattcctgtatcaacaacacacgttcccggagccaaaaagaaattatgttcttcttcattctcttctgttatcaacctagcttccccacctccaaagacaactgcggaactcaatttcttatgctaaaaatggaaggaaacattttttaaagtaaaatgtagtaattttttgaacacataagaatttgatttgggaaacatagaagtacaattcaagaagacttggtgctacttcttgagtaggtcatttcagcttccactttgagaaagtccctagttcaacaggtctctgcggccctggaactgttacactctctgtggttcctcatcacacttcctaacagcactctaactgtgggcttatctgcatttctccactacaacataaactcttggaaaccccactttggtacacagaacatattcaactgatttaacttctttagtgagcttactaactaaagaggtttagcttactaactaaagaagttaaaactaagtttcctgtccttctcacttgcatatttatgaataggccagttatcacagattttaagaaaccccgtaatcacagccatgatcactgggcaggtctggtgcctggggtttttttattctacttcacacttttacacaaaatcccaaaatgaaatacgttaacaactactgataagagttaataatgtatcctagtttgtaatgtattctttaggaaaatttagcttataacataattacctgtttggcattcaaaaatataaatgttttccctttgaagatttgttttctttcctgccgtcctgacagatcaacatttttacttccaatagatggttcatcaagaggtgggtaaaaactgtaaaaataattaaagtatattctaattatatactactatgtttgctattaaattgtaaacggagtgactatctgacactcaaaaggcataatttccataatacctttatagtattttttttaagtaagaattttatctgggacaaaatgacaaaaagcatctaatcgcgttttctagaaatatggtggcaggtgacacaaagaagagctagaattgatcattaatatctcaaaataaataatccaaggtagacaatcataacaggatgaacattaaacacacatgactcaaacaaggtgtctgaattacaaaagtttgagagaaacatcatccataaagatcaaattctattagcatcttgtgtttacttaggagccaatatctattaaaacgctcatgtttcaattctactagcacaatctattatgagtgttttgttagagatctctttggagaagttcaggaaatttttaaacttacattatttactcagttcaaataaaatttccaaaacaagactaaagaatataatgttttagctctttaatttaatgctataagaacatcttaatcatccatgaaaataaaggaaaataagaaatggagaaatatcaacagataattcttaagcctctcatcagtctagagtttcaacttcctgtataatcagatcttttgctacagctgttcataactgaccggcatttcgacttgtctctcttcctttcagtaaaaattactaacccatgatgatgatgataaggggacaatgtagggagggagaaattcacaacctggacaatcagtcacaaatcaagagttaactatctgcagagatcaacatccaacgtggtaaaaacactgcagtcattaagagtcactatccagcactttagaactaattaccttacatctttcccctggacttctccttggaaacatacatatttcataaagtaaagctaagttatgattgaagagttacaatactttaaaatttttttgataactgatgcatgtattttaatttcactacaatagatgctgtaagtctgttttaaagcaatgatttctggaagctgcaatctcaaatgagttatctgcaggcaagagcagactcacttggcaggacagaatgcaggcaactgcgttagttatggtttttctaaacaaccgactttaaaattctatttattttacttttaaaatatacagagaacagtggaaactattttaactgttaacaaaaactaaatctacaataagagcactggaaagttagtagacattcggacacataaaaaggatcaattttaatatctctttgaatcctttttatcctttatctcctaataaatattcccccataacttatacttctttcttagtgtaaaagccaactaacactttacttatatacaaataactagtttaccaattagttcacacaataatgtaacaacactaggacagattacagagccagttacagacaaaaacagtaaggaaatgtttaacacatatgactgtgtgttacagtcaaacatgactataaaactatgactgagtagatgtgagattcttcctgctttcccaaaacactaaagttgaatgatttttaaattatctacagctttctattattcacactgtcattcttaattatgccatagataacagtttacagtagccagggagcagctaactgtagcttagttcgatgaagtttgagccaggttcctaaacatatgtgtatggtagcctgttaggcctctctaatggctctaccagagttctaactttattagtgtcattctttaacagctggcttctccactaagtgccatgagggcagaaactgtaactttttttggctcatcattatatccacaagtctatcttgcctgcttcactgtaggcattcaatacatatttacaaataaactgacattacaaaatataaataaaaattcaacttaataatttaaaagtgaataaaaagtataaacatccttcaattccctcaagtatagatttaagtattaaaattctagaacttgaacaatgtattttggttttgttttgagaacactgataaatttgagccccaatacttggtaagatcaatcttgaacaaaaaaatacaaaactgtattatctagaagctaaccaaatgctggctatgactccaacatgggttattcttagtaatacctacatttgatatatgatagacacattcatacatagataattgataacacagtgatcaaaaaacactatgttctagaatttcaaatacctacataagcctttttctctttaccagtgtaatgatgagagcaagaaagaaaagactagtgatgaatgtgaagagatcattgaaaatcattacgtctgaagcattacattctagaagttttaaagcatttctgacactctagtaatttaataaactagtacaaaaactggaaaataggaaagtaacctgtcagagacctaggctagaggcatattgactgaatataacgatactacaaatataaagtgatctccaatttctatcattaaaaaattaaaatgttttgggttcgtttatacagaaactttaagagctacaaataattatgttttattacacagtaactggtacatattatgaatcatacattctataaaatgatattaatctagaaattttgctttttcccattcacattttctatttaaattctttacatgatcttcaataaatttcatctaacctacagtatatcattttcacttctgtacgaagattttgcaaatacagaatttttctgaatccatgtataattctggctctagaaactgtatcccaagccacacatacttatttgttcaatatctggacagctgtttatttcattagtcctgcaggcatatgttcataatttctagaaccatttactatatggcttttttttttttttttttttggtgatcttgaaaaggctagactacagtgacatccacaatttgcaaatgtgaggttccatatcctgaaaaaaattactaatactagtcatatttcttaccttcgatttaaattaactatgtaaggtgacttctataagcttcctaaactgtcaaactttcatttactgagattatttcaggccaatgtgtctgttgggtctgagatttgattatcagctggtaagttaacctgttcctgtttcatggatgctggcagaagacaaacactcctgagtcacagcaaagcaagcagcatgagccccagtatgtttgctgcaggtctcctctctgaccaagtcccatagggaagacgtagagggtacatacagtgaaaggtacatacagtggtgtgtgttacaggagagaggaacactgaacttgggaaaccaccggtattataacaagctttaagcaagcctacattttgtcacaggaaggaaacattacttcatccctcgaggtttctcactgcaaacatacccttgagaaatggtctgtgtaaaggagggtcaaggctttgcattcttggcctattcagcaaattgtttatgaatgcaagggacccatggaggactccatctctcaagagtgtctcactaaaacaatacttgttgtttgaaataattaatacaccatcctacaacatgagagactttgtaaaactcaaataaaagccaactccccctcctttctgggggataatctccttacatttagacatacaaatctcctctattagagcacagattattgaaattaaacactccttttaaatgtattcttctaaaaatgacttcatctactttactactttgatgacagtcaaggaaaatgagatattgcaaatcatttcatgtacatgaagttataactgtcatatcctgtttcttggtaacagtgcaaagatgtagacatagctgtactaaataggactgtatattttattggaaaaaatattatagtatgcctcctaatttaaatccaggactagcagtcatgcttttttggaacattagaggtacttatgtaatcaaaggcgtcaccacaatttatttcatatccttttcgtaacccattccttctactaatgtttataaattgaatcttttttctgttaattgagtactcagacaaataagccttcaacaagcacatcaaaatggatccagataggtataggactctattaaggcaaataactaaatatatttaaaaattgtattatcaattgccatcatcgaatatgggttaataggataaataacctgtcccagttaacaccgaattaggagggattcaacaatcttatggtagggatgttgtatagtcgtcatgtacattgatacaatcaaaaattgaatctagaaaaaaattatgttgaacttggtcaaaaacaaccttaggttaaacacaactgacaatgtgaacaaaaagaggaatcaacgactaattctaaaaactccaagaccatgaaatatatctactagtagtgaaaacttatcagactcctctatcctcaagtataatctagaattaagaatagctcactatttgcagctagagtcattatttacaagatttatgtacttcctcagggaggttcctcaagaggcttcagggaaaaatgtgattctgttaaaatactatgcaagtttgtagttatgtcggtgaagtttcttgaggtgagatcagtgctttcaacttctttttttttgagtcgcccaggctggagtgcagaggtgggatctcagctcactgcaacctccacttcctggattcaagggattcttaagcctcagtcttccaagcagctgggattacaggcacctgccaccacacccagctaattttgtatttttagtatgttggtcccactggtctcgaactcctgaccccaagtgatctgcctaccttggcatcccgaagtgctgggattacaggcgtgagccaccagggctggcctgctttcatatttgcaggagttcagtcagggtggtgggaaaaaatgtagaaagatgcaaaccttggaaggccaaaaggttttacatcagtttcggaacaggatttggctgaaagcagccagattcttttatacggtgcctgaaagcttaggttagataacgggatgttaagaaactgatctagataagttacttagctcggaacctggcctttaatcattcgtaggactgctctctcctgggaggggaaccatgttaattatccacaagtgtgttgactcaaagcctttgccattatatctatactgaataaatgaccacagcaacagctagtcgggaccgcggctgctaactctttacagcaccctcctcagtgtctgtgggtggcccagccccctagctcactctttcactggatacctgtgtttgagtgcatttgttcatctgtcgctgggtcagggtctgcgggtcagacctggcacatactgaggggtcttggactcaaaaaattttaagaatcttctattttaaaatctgagtatatttttccagagtccaaatatatcacattacctgccaactggagtataaatacaaaaaaacttcccagataaaaattataaacaaagaggaaaacctgattttttattacttttaaaagcagacagctgttatccggtataaacagtccctaaaaaactaacattaagccaaatagcttatagcagctcaaaacacattaaaattagcaataaaattcctaactggcataacatttaaaattttttttttaatgttactttaagttctgggatacatgtgcagaacatgcagatttgttacataggtatccatgtgccatggtggtctgctgcacctatcaacctgtcatccaggttttaagacccacatgcattaggtatttgtcctaatgctctccctccccttgtcccccacccccaaacaggccccggtatgtgatgttcccctccctgtggccacgtgttctcattgttccactcccacttatgagtgagaacatacggtgtttggttttctgttcctgtgttagtttgctgagaatgatggtttccagcttcatccatgtccctgcaaacgacatgaactcattctcttttatggctgcatagtattccatggtgtatatgtgcataggtatggacatatacccagtctatcattgatgggcatttgggttggttccaagtctttgctgttgttaatagtgctgcaataaacatatgtgtgcatgtgtctttacagtggaatgatttttaatcctttgggtatatacccagtaatgggattgctgggtcaattggtatttctggttctagatccttaaggaatcaccacactgtcttccataatggttgaactaatttacacccccaccaacagtgtaaaagccttatttctccacagcctcgccagcatctgttgtttcctgactttttaactcagctaggtaggtattactctcaattttgcaatgagtaactggagctcagaaaaactaagctccattcccaaagctatggtgctgttaatattctggactatgtggcttgcaaagagggctgctgcaccacacaattccagagctaactgtggcgtgatgcctggaactgacatatgtgctcttctgaccatgaggttacctcagtgccatttactgtctttccatttttttctttaaatattagcacatatttaacatttgtttcagagatacagaataaccaacaaagaaatttggggaactctttctttacaaactaacaaaaaaccttccattaataataccgaactataacacagcaactattacatcctgaaacaagcattaaagagggaattaacttaaataaaaatcaatgctatcatataagtgacatcttgttatatttaaaatacataatatacctttcaatttgtggaggctgcttcttggactcaactgctttcaggaattcagtaaaatattctggctttacaattggacgtccacaaatgagtgcacatattgtctacaatgaagaaaacatgtgaatatatatattcacatgctagcattttttaaagaaaagttttaagttataaactacaaagaggctgtttacatccataaaaaataatgttttccctttcatctctctaaatttataaagaagccacaatctataaaatagaagtcggtctttggtcactgcattattttagaacataaatcacagtataatcactcaattataagaagtcaccgattataatactaatttttaaaactgcttttttggaaagggtggaacaacataaaataaaattcaattttaaaatgcattccactttcgaagacattaaaatgttaaaaatatatttcagaattgaggaaatgtaacatatctgcttcagggaagacaatattaggagatgaacatgagctatttttagactaattgtctttcaaaaagattgtaactatgcaataaagcctttttgagaaagtaaataaaataatttttggtaaaagcacaaaataagtacatataaagtggaaaaaaagaaacttaaactcacatgtgaattaagctataagcctcaaatatgatacatccaaaaaatatgacaaacattagaaaatgctacagtgggcaatgaaaataagattcagaataatataaatatgcttttttatttttgagacagggtctcgctctgttgtccaggctggactgcagtggcgtgatcctggttcactgcagcctcaacctcctgggctcaagcaatcctcctgtctcagcctcctgagtagctgggactacaggcacatgccaccatacccagctaatttttaaaattttttgtagagatggagtctcactatgttgcccaggctggtctcaaattcctgggctcaagcaatcctcccacctcggcatcccaaagtgctgggattacagacgcaagccactgcacccagccatgaatatgctttcaataacacagggtattttattgtctaaataggggcaagcagatttagattgtctctcaagaatggaacctgaaagataccactttccaatgtgaaagaaataaactagcatgaaccagtaatgtgcaaatcaacactgtattgggtaaactctaatacatgtgacttgggaaattaattggtccatgcctcagtttacacttcagaaaataaaagttgaactgaacgctttttttgttgttgttgttgttgttgtttttaagtagctaatagtaagaataaatggtctttaaattcctttttggctctaacattcaatgatttaaaaaatataagctaactgtactttcagaaaatttaccaaaaaaaaaaatataacaacaaggttttctattttggcatatgaatgaccaggaattttttttaacaaattactctgtaaaccacgttggtgtgtgtaatggagcaattcacaaggtggtcatcagcatcccactcgctggaagtgtccaggtctgtcacagatgtagtaaaatatctctcaagacaatttaactacctttgattgtatttcacaccaaccaagctagtgtatgattacttactctatttcttaagtaatatcttaaagaggactgtgctagggcccacacttaaatattctggtaaaggtgcatccctactgaaaaccataaatggacactttgatttgtaaatctactatttgtaagtttatatgcatatattagtactctggaggctaatcacactgctgaatttataaaatcaatttcataaatgtgcaaaaataaaaaaacccttgattacagacaaccccaccaaagtacaagttgagttccagctgagcggcaagcctttctccacgataactctttagctataaaacataattctagtttaattatattaaatactaaaggatttttaataaaggaatctaagtatttgtggctttttactatagatattaacctaaaaggatcccacaaatctataggtcaacctgtttaaaaggagatgaatcacctggagattggagaaagacaacttgatagaaagacatgagatgcaaactttgaagactggcagttaatctctagttgcgttgctttaagactgaaaacacaaagtatgcactgtcataaccttctcggtggaaggacaacagaatcgctttttaaaatgctaaacaaaatctgaaatataattttagttgcttttggcttgtctcagataataaacaggttatatgaaaagccactcaagcctaaatggtatacaaagggatggagtgggtatatataaatctacaactaacagttctgatagttttaaagtaattaaaaaaaaatctgtgtatagtgggtaagcttaaattcaaataacttatttttaacataagaacaagacattcaacctactttaatggtaactttcactgataccatgacaaggtgagtgcattcttctgtccaattgtttacagtaaatcctccaagttgcaatatagcttgatttaaagcagttttcccagagacatctaaacaagaagagcatgcaaccaaaggctcatactctattctgtaaatgagaataagttaaataaagtcatagtatcagagttgcagagatggcaatttttagtactttaaaactttaagctcacatcatatactgttattgtaacttttatttattgttaccctttgtaacctatgaaattatcagttcctcatcattaagctttgtaacctagaaaattatcaaatcctaagtcttgagtccaaatgaagaaaaaacaatgaccaaaagttaacattataccttcaccaatgaggaatcgaagaaatgtaacttcccatgaagtccctcagggcccactcaaactctcatcaccgtgatgtacaaaatgcactcaccacccatggcacagagtccaatactgtgctaagcaggaactaaattatactgttttaaattcattaatcagaaatatcattttcctttaggatttggctgaaacaaagctgtccattttaaaatcaattttaaaatgtcttacctgaatttacttccaaacactccaaaagtaataccatcccccgacttcaaagttcgggaaaagccattctgcattttttcctcattaacaaaggtaccatacttagaattatcttttaatgtcaatacagggatttcatctgtttgactctgaaaagttagcaaataatttaaagtcttttaccactcagtacattcacttctcagagaaaaagttttcaaaagaaaagacaataggcaggtggctaacctcccaacacggcagacaacaattactgcttcggttgccttgagaggaagatcactcaactaacaattcatatttccccttagggaagtttcttaacccaggaatacccctcctagaacacacatgttctttatttgtgtaagtcagtggggattctcctgacccctcacacacatttgagaattttttgctttggtgcagtctgtttcatttaaaacatgacaatttcattcctagatctttttttgtttgttttacagtatcaaaaccacattgtaaaaattagtcccatgagaatacgaggttataggctagtgtttctgacttacagtaacaattttactttttctgtagaaatttccaaaatgtttttctatacctaaaagaacagaaacaaaacctaaataaaactgaagaaattcatatcgcatatatgcaatctttgattaaaataatggctcatctttcttattaccaccagcgttatcatgagtacagatattcctatgtattttttttagcacttttatcacccaaggttatgatcaaaacaaactgaaagccatttaaaggagctgtggggcataagtaagcatttccctaataaaacaaatcaattcccattgcaaaaacttgtattatatgagaaatgcccgtttccacacagctacataacctctttaagagccagagtcatgaaggtctgttcattgttctattcgcagggttggcacagttactgacacataaaaacacattactgctaatggcaaaaacagcaattacttttgcaccaaactaatagtaaacaataaatgtttagtaagcaaataaaaataactatgtcctacttcctctgagtttctaactaaaacaaagagtaaattactgaaatagaaacttcaaatctcaaaatgaacaaataccactggtaccactgccacaatataagtatttaattttgttaacattaaaaaagtctacacagctctataaaatgacaaatcctgtgaactctctctcacatacaaaccaagagaatattttgtgatttcaacccccttactggaaactagtgaaataaaattagtaacataccaggttggttacagaaaagttagcagttaacacagcatgatttcggctgatcgactgatcattttcaatcagaatggcacagtttttccttccaacaacgtactcaacgccagtcaaaagtctgtatggttctcctgagataaatttttttttaaaaaaagataagttgatagacacatacacatgtacacgaacacacacatacatgtaagtgtatatgatataggtatgacaaatattaaataaaacacctttgttattcaaatgttagtcaactttacatatgtcaaacttgtgttttcagtaaagcctcactgaaggctatcaaaggttatctaactatggtgtttcaggagtaacaacaacaaaatttaaaatacaataaaaaagagaaaaagaaaaaaaggttatctaaacagatagaaggctacatcatttttctaaagggaaagcaatgctgaaaggagtcaatgttccctcaaattaacttaaaaacttaatgtattacctagcaacaatcacaatattatgtttggaacttgataaacaaaaatatcaggaaactataaaaaaagatgctcaagcctgtaatcccagctacttgggaggctgaagcaagagaactgcttgaacccaggggatggaggttgcagtgagccgacacagtgccactgcactccagcctcggtgacagagtgagactccgtctcaaaaaaaaaaaaaaatcaagaaaaatgtgaataatataataggagcttgccctaccagatggcaaaatatgccataaaactaaaagtatggtactggaccatgagtaaacaacacagaccaatgcaacaaagtccagactaagatgcacgtgtacattttttgaaaatttgtttttatcttaaagataacatctccaatcagtgggaaagggttatcagtttcttttaaaattgctgtaaatcataagttgttggagtaacagtatatatattggagacatgcggagttgagtctgggagcataatttcattacccgagtggcagggagattagggcagataaagagtagggagtccagaagagccaggtctccagggacgccttgacctgtgagtcttcacagtataaaatttatttagtttggcgctctccatactctcttaccctgccagtccatttagtctctacatagatctttgccaatcatcatgtaaacttcccgaggacaagacccttcacacccaccacgggcaaccaattaacatgtgatcacatttcacaccgctggaaatgaatgggaaaaaatcgacttttcccattgttctgatgacattgtggaaaaggagtctgaaacaaaactgaaagtaagccttttcgtggtagtcatttccccaaactgtccagtagttcttcacaagtcatgtgtggcccccgtgtggtccgcccatgctaacttcctgccgggggttcccactaggcgcctgctgccgcttacccgcaggccatccagccctagcgctgcaacggcgcgggggtgaggctgggagggagggggagtcaggggaggggcgcggaggactgccaccagggggcgccgcaatcaccccaccgcccgcgctgaattccagctcacagccgccgtgctgcccgggaagaatatgcgcttgccatacagcgtactcgccgcttctgcgaccgcttccgcagcgtccccgggcaggaacggacgcgacgcaggaatcacccgcaggccctcccccgaggcagtcgctaccgggaaaataggccccgaggcttcccttctgcccttacctcctgccgggcccgcggcgggcagcagtttccacatcggtccggctcctcagggctggggccgacgtgcaaccgcgtaaccggggctgctagacgagcgcggatacggcgcctgcggtcggcatgggctccgggacgtgcgcgctc

SEQ ID NO: 1880 - DNA, 109655 bp, Homo sapiens
gctcgctccctcccccgcgcgccctccctcgccgcctcctcccgccgcctgcggcccccccctcgccggggaccgagcgcgctcgctccggcgccggcctcgcctcctcgcagcagcgccatggtacgtcgccgcacccactttcgttttcgcccggggactttttggggtggtgcgtgggctccgggcgaaagttgcaagatctggggggacagggggcgggggccgcccggaggaggggctcgaggcggggacccccactcgccagtcgccacgggacccctacccacgatccccccccgcaccccggctgggggcggagctggcgcgcggggcgccgcgggagaccccaagtggggggcccctcgcgggcgccgcgagttggcgaggagggcggggctccccggagaaggcccccgcaaccccaggccgggcccccgccccctccccgggccagaccccaggcgggagggcgcggccctgggcgcacgacccccgagcgcgcagtccgtgggggagcccgggccagggagggggcgcacggcgggacggcgcgtggggcgggggtcgcggcggcccccgcggggtgccccggcccgggcgagcgcggcgcgccagctagcggaaaatggccgctgcggagaggggcggagagcgcgccgcggccgccgccgggcgccttgaacttggagccgggcgggcggccgcgctcggcgccgcgcaggagcagccgccccgcctgccctcgcaccgcccccgccccgcccctcggcagacccccggccccgctgccgcgcgcgcggggtccccagctgggagggacccccgggtctcggcccggcgcgccccaggccctggagcggcggtggctgcacttggggttccggtgtccggtcgactggcgtcggtgtcgtgcgcacctcgaggggtgcgtgggagcccctgcgctccgtaacgggccggcattggcatctgggggagcgtctggggtgtgcgcggcggggtggtagtgtacctgccttggggccgcgggtcccggcgcgtcggctccgccgctttctgtgtccgcgtgtgtctgcacatccacgtgctggcgcgtgttgtgttgtgagcgccgcccgcattgtgcggctgcgggacacttgtgtctttggataactgggcgactgtgcgcgcgtccctgcgggacggtgttgtgaaactatggctgggctgcgtgtccgcggagccgcgtgtccctgggtgaccgtggggtgtccccgtgtgggtgtgtggcggttggggggggtcgccagggagtggagaactgtcgagtggccgcgttccaggggacagttgggtgccgcttgctgtgtgcgagtgactggcgctgagcctccccctagggaagggtctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagcgtaggggcaccgggactggtcccgcagtcccgcctccagcacttgcccccaatggaccagaggccgtgggcacagagagctgttttgtcacctccagggaaatccccgccgctctccacccccaccccacccccagtgcgtttgatataattttctaaatataaaaagcccaaggccaggctggtctctctcgctttcttcttgacatcccatcatggggggctgtttgggatgtcaagaaggagagaaaaccctcccacaatgacacagaggcctcccccaacaacactcaaggtcattctcgggttgtcaccatccctcacacccactcccagcctcagactcacagctatctccctccgcactcccggagggacggttggatgccctggccttcagcacacggcatggccctctgtccccattttgggttctgtgcacagtgggacacacgtgcatgcagtcatagttacacacacacacacacgacactccctcacggtgcctgtgtctgcatgactctgcacacacaaccacacagagactcacatagacacacacaggcctgtctagagacagacgtcacacacacaggcgtgcacagacacacatgggcagacacactcacggacacaaacaccgcacttgcggggggatagacaaccacatctcaccctcctgcccttccctgtccccaccgcgtttctgcagggccgagagcccagctccaggcagagctggtgcaggaggagcagggaggtggcgtgctgtgtgtcattgtgatggtgcgtatgtgactctgtgtgtgcctgtatgggaataccggggggttccacttgtgggtgtgtgtgtgcttgtaagagtgtgtgcttttgtgtggagtgtgtctgtgattgtggacaagtgcccatgtgtttgtggttgtgtctgcacttgtgtgggggcagctatatccatgcgttgtgcttgtcaagaagcgtcctgtggggagttgggagggtgtgtttgtggctgtgtgtgtgccatgtgggtctgtgtgtgtgtgtgtgtgtctctgctcgcccctctttgaggaggtatctgaggtcaggtgtggggggaaggctgtgatgatatatgggtctgtttttatgtgagtctgtgcgtgtatttgtgtctttgtgtatgtagctgtgtgtcgtgtggagtctgtgtctgcagctgcttgagtctgcacgatgtgtgtctgtgtgtctctgtaggtcgtagtgtgtggtgtgtgtgtctatctgtaccagcctcaacggcctatctgacctttaactcacttgactttaacatcccttcttacagcctcagtttctcatctgtaaaatgggaccacatgggacccttgcaaggttcctggggagctgacattgtgagccccttgctgagcaggtgcggggctaggggaggctgactgcacactgcactgctgtgtaatcatttgcctgcaagattatgtcctttattctctgggtgtggtggctgtggggttaccatggggggctgggggttcctgtctaccctgcctgagctgctctgtgaattgcattcaactttttaagttttcctttaattactgaagccattagtgatcatatgaagaggatacaactgtatccagaggaaaaaaaatccaatctttctgatcacccccattcctgggtggaaccccgctccagaatgttaccatctatagttggagcatttgcaggactgagaaatacacacttatagaggatacatgtgcatatgtgtatatttccataaaggatgtacttgtggaaatactcgtgtatttccataaaggagacatatgtatatgtatgtgtatgtgtgtgtatatatatatatatatatatatatatattttttttttttttttttttgagatggagtttcgctctgttgcccaggctggagtgcaatggcatgatcctggctcactgcaacctccacctcccgagttcaagcgaacctccagcctcagcctcccgagtagctgacattacaggcaccctcgcccatgcccggctaatttttgtaattttagtagagacggggtttcgccatgttggccaggctgattttaaactcctgacctcaagtgatctgcctgcctcggcctcccaaagtgttgggattacaggcgtgagccactacaaccggccaaaggagatatgtgtgtgtgtgggtgtgtgtgcatgtgtgtgtatgtaaaggatactatgtatatttgtataaatacatgtgtactctttaaaaccctaaatgagatcttgaatttccttgctgggtctacagcagtggggtctcagccagggttgattctgttcccatgggacacttagccatgtctaaggacatttgtggttgtcacgactggggggtgcccctggcatggagtgggtggaggccatggactctgctcagcaccctgcagggcccaggacggccccaacccagagagcgatccagccccagtgtccacagtgccaagggggagagctctccagctttctgtccccccacttgtctcttggggacataaccagttgggagccactggttttactcagctgcatagtgtcccagcctgtgttgggattactaaaccggtcccccacagatggacagcatggctgcctccaaattgtgggcattagttttataggtggcagtcaactcttttgtgctcctgtatctgggacagttacagagatgccgaagagtgaaataactgtagagagagtgctttgaaaaaaaaaaaaaatgagccagattgtgctcgaaagtgccaggagctaaatcatgcacccatcttccgggccctccacatgcaggtcccaatctaccaattgcctttttaaagaaactatgacgtacagttccctgttgtaaccacgggcaggtatttgctgacttgcctacaacctggagggttatgagctggcgtcgccccatttcacagagggagagccgaggtgcagagagacgaagctgctgactggaggagacatagacccaagcagcgagcccacgcggcaatttagggaaccaactgtgtgtgctgcgggggtcccttgccacccaaactgggatataggctgctgttcgtacacttgcagaagtttctccctgcagctaccgccaccaataatattcacacagccttcccacatgctatgtaaagactccaaccttccccacctcccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttatattggtatgtggatttccagatacacttctcaccatttaattcaaatgctccccacagctgcacagtgggtttaaaatacacagacacacacatttatggaccgttcgtgatgtactaagcactgtttgaataatgtcaccgtcatgcagaggggagcctgtggggggcctagggaacctacgctgcaggaattctgctccctcctagtttacctgtcagaccctgggcaagtggcttccgttctctgggcctcagtttcctctcctgtaatgcctgaggataatgggtgctggtatcttctgcgcccctgggcctggggcacctgccccagcttggtgagagggtatcatttgtccttgggaagctcagagagatgaggtgaaatggccaagctttctaagaatgtgtctttagtgaacatttgacccaaggtcaaggctctgctaaggtcattgtccttatccccagcaatcccacaggatgggcatctttaagccactttataggggagaacccttgggatgggaatgagagacacagcagcctctgagctagcctgggaggatccagggagtgaaccgggggagggttggggccctgtcatcagatgccctgggggctcagacggaggcaggccaggtctctgccctgttacgtctagaaggagaacagaatgtgggctccaggtccagatggcctggctccaagccacacttgccatacctcagtcttgagatctgtgaaaagggcacacccctgaggcaggtggaaattattggatacccagggggaggctgcaagggtttatctggccagctggagatcccgcctggacaccgtcctcctggggtgctggagagacacacaggcgaggccacccctcccctgccccttgggtgctgggtgaagagagcaaattctggagcctcccgtgttagcctgggcccttctggccaaggaagggacagctgcacacaagcccctctagctggggacccgcagcccctgcctggctctggggggagaagggagccagggtgctgtgggaccagctcaccgtgcacccagggtcgtacatctttaaggggaaagaggcgcgctggccggcctctgcgcacgtcacttcttcattccttccctcccccctggctctttcctccaacttcccggccagctcgggggtgatgggggggtggggagggggggccttaaaaatccacccctggcccctcaatgtccagaaacaaccctgtcccccctctccgcttgatccgaattggggtcgccctgcagtcctggggtcctggtctagtgccctggggcattgcgtaaatacgggaggagcgggggggtcctgagacgtcgggggaggctctcctttctcgctcgcgcccttttttccctcgtttctttgaaagttgggtgttgagaagtgggaggttcggggtgggagggggagggtgtcagagggtagagagagagacagagagacagagacgggggagagaggaagagagagacggagggagagagggacagagagcgaggcgggcggcgcgagagagggagagcaggagggaggaggagggagaccgagggaggaggcggcgaggagagcgcgccggccgcggggcgggggggggggttggggggggcgggggggtggtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 1881 - DNA, 109655 bp, Homo sapiens; identical to SEQ ID NO: 1880

SEQ ID NO: 1882 - DNA, 102651 bp, Homo sapiens
tttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgggatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctggagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacagagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgagtggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcgttgtttccttcattcgttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaatttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccaccgcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccatttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtcctcggcaccctacctgggaccggcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacctggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacgtggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcattttttgtttttttgttttttgttttcccaagatggagtctcgccctgtcacccaggctggagtacagtggagtgaccttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatgggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgaggagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccaggggtcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctcgctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccacccaccccccacccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcagggctgcagccaggctgggggctgggcaggtctcaaacccctggacctggggaatcagggaggtgtgagctgcatctgaggtcgggtgtctctgtgactctgtctctgtctctctacctctgattctccccaggctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagaggcaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccgccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttctctttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtagccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctgcggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccccgtcacagccgccgagtcaggcctgccaggaaggtgttgggggtgggggtgtggggaggcctcagcttggctgctgggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgtcaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcgggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaacatagcgagactgcgtctctactttttttttttcctgagacggagtctcgctcctttgcacaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttatagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgttgttttttttgagatagggtctccctctgttgcccaggctggagtgcagtggctcaatcatagctcacccactgcagccttgacctcctgggctcaagcagtcctcctgcctcagcctcttgagtagctgatactacaggtgtgcatcaccacagccaggtaacttttttttttaaagtagagatggggtggggtatcctgtattgcccaggcttgtctcaaactcctgagctcaagtaatcctccctccttgaccttccaaagtgcaggaattataggtgtgagccaccatgcccagccctccagtgctttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcctgtaatcgacatcgtatacaattggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttagatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaactcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcctaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagcagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttattttctgacttgttcatttcctgtcacgttcccattagaacatcagtgcctcgagaggagggattcttgtctgtctctgttgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctactgcgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggatgggaacccagatctgcttccctcccaggctacacccctgtagccccccaacccctgcaaacttgttatttaagcctcctcattacaggggtttggagccgaggaagccctgctgccttttcgtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaatttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtgactccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattacaggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaaaatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcaagtccactcctaggaggtccctagagtcgtcagattcatagagacagaaagtaggttggcggggtcagggggtgtcggaggctggggaggggacggggagtgagtgtttcatggggacagagtttcagtttgggaagagtagaaagttctggagaggatggtggcgatggctgcatggccattggaatgtatttaatgtccctaaagctgtgcatggaaagttggttcaaatggtaaatattatgcatattttaccacaataagaaattaaattaaaaattaaaatgagatggcatagatttatagcatattatttttaaaactaaactaattttggccaggcatggtggtgctcacccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagtgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcccgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccacgttggcctcccatagtgctgggaatacaggcgtgagccaccgcgcccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcggctgcagggcttggggccgagctgggcacactcccctcggctgctgtccagcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattctcacagcaaccctgagaatggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctggtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccgggcgtggtggcgggtgcctgtagtcccagctactcaggagactgaggcaggagaatggcgtgaacccaggagacggagcttgcagtgagccgagatcatgccactgcactccagcctgggcgacagagcgagactctgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactcccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagacggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctgtctcagtctcccaagtagctgggattacaggtacgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaagttcttacccacgactgagccgcccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccagagggttctacggtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgatcctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaaccccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgtggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaattttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggggggaggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttcttttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccgcccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccagtgcactccagtctgggcaacagcgtgagaccctatctcaaaaaaaaaaaaagaaaaagaaaaaagtctgccccctgctcacaacggaataaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggagtggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcgtgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttacgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcattcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccctggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaggggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 1883 - DNA, 102651 bp, Homo sapiens; identical to SEQ ID NO: 1882

SEQ ID NO: 1884 - DNA, 102651 bp, Homo sapiens; identical to SEQ ID NO: 1882

SEQ ID NO: 1885 - DNA, 115990 bp, Homo sapiens
gtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccgaaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataaccatatttaactcaaagatttttttataaagctcataatctgaaaaaatgcttatggtattactaaaacatttaatagctctggcatcaaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgctcattgtggtagatacgaggtctagatagggaattggcagctacatgaatgttggactatcattccatcagcaagaccttatttttacctaatttatgagaggtatttctctgttcagaagaggtgaaagttctggcttctggggggaagtggttacttcataaccttcaattggtttgaacttgggagaagtaagaaaagtagtcgatattttcaaacagtaaaataattgtatctgagttgctgtatggatttttgatgaagtactcaaaatgtcatcttttgcatcttcgggtcttagtagatgtgctattctgagtatagaattgactgcagtaggaagtgtatctggaaatgcacagtactgttgtataaccaatagagtaaattctcagattatgctcttctggtccacagattgatcagaaatcacattaacaggaatggatgtctatgcaaaatttctcattaattttcttacttttagtaggaagtttgttttattcggttggtctgttggttttctgtttacaaggtgaattgtctacagtagtgggattgttatattagaagagaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaaaaaagtagtaacattcttttaatgatgatgaaattgcttcatacctttggtctctgctgtattaggggttgttcctgggtgcaaattaatatactgtcttttacatttccggaggttgttgacctggccttgaagatcagccaacagtttagaaaataagttgtgcaaattgcattgctacacctcaaataatttaaagcctgacagttctgtacagaataagagtcacataagatgtgatttgttaaagattatagaaatctcagaagatagattatggatgaaaatatttgtttaatttagagtactaataataaaaatagtgcattttacattttaaaaagaaaacaatttttattgtgtcatattttctgtagtaacaaacagaattaattatcagtaatacaaatttcatctgctttaatttattgcctgtttttgaaattagaataatgatatatttggtttaattatccattacaaattgccttattatttttcattcatctttcaccattaatccagaaaccttaaaatagcttttattttgacccatgccttcagtagatatcaacagacttgagttcatctatggatcctattagtttaaactgtgacaaattttgactgcttaagctttagaaaagaatttattctttaaaatagccaaaattataaaaaatgaaataaagaaaaagctgtttgagagaatcaaatactctagtttaactaaaaataaataatatctaatcaatactgacgaaagaaatatctgatgcttagcattgtacttgttggtacatagtaagcaatcattaactgttaaatgaatgaatgatatgaagttgttgcaaaatttttttttaaatggacagccatcttctataaggaacaaaaattacattattttgctttgccttctggaaagaaaggagcacaaaatagtccttgtgtcttagatattatggaaatcttatctaaagaccacttgaagtttactagaacaaataatttattaaaaagtatctggcgccttccaaaaggggaacatttcattctgaaagaggcatttatgaactagaaaaaaaatgccttttagtttcaaagttttagaggcaccagagcaagattataaagtaattggaatgataaaaggtgcttgtaaaattgaaaaatgtaattttttggtgaagttagaatttctgtacactccattgaaactgtaatatcaaatactaatacctccaaaaaagaaacaatgctacaagcactgcttggtaatctaagaattgttaacacttatctaaattaatcaaccaaaaagttaaaacaaaatatgttattttgttatgttacctctagaattaaacacctatcacccataaatctgtgactgttaaaagttactagatggcaaacctcaggaacaagcaggcagttagcagggtttactgtactttccactttcatactttaatgatttttccaacactatagaagctggggcctcatcctagcacagtttgttcattatttttcagttgtagcattttttaaaagttggccttgaatttctgaattgaaccatttatttttttgtggacacagttttttaaatgaaatataccatttagactagaaaagagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacctgcataaagttgagcatacctctataatgtcccattttaaaaagcaatttgtttttaatgacttttatttgttaaaagcagttatttcaaaaaattatttttattatttatcatgtcatttggactgaaaatactataccatatttcagtgttagggcacacctatccctctttatcccagacgtcaattctaccatataacaagtatgtaaaaaagaaaacataaaagtgatgacagactccctaatcaacctatttattggttctaagcccaagcctgcagttcatttaaatagtgaaaatagattacttaattgtcttagaaaatatgtcttccatgacaagaattttaggaatgagaaaataactatttttggatgttttaacacaaattcccaaatcatgttttattgatatttgaagaacctctttgtctaccagttcttaagtataggcttattttgtaaggcttaaacatgtattggtgtttgactgttaagacttgatctataaccttcagtgtctttttcttttaaatggggtatggacttggtaatgaggccagaggagaataccttacaatttatagcatctgcatataatacaagaaccttcatgatttataaaattaaaatgatgatgatgtggaatgatggaagaagcatgtgtgggtggctatttatgtagaggaaattagaagttgaaagcaatgttaagaattaaaattaaattacacttaattttttgctcagttggatagtcaggaaagtacttaaatcagcaattgatttacgtaaaatcaaaactgaaaactgaatatacaatctaggaaataggaaaaaaatttttagtgtgttcatactgctaatttcaaaccaagcaaaaaacctggggaactacttttcagaggagatggcttaaaatgaaccaaaaatatagccatttctctaccctattcatttaatgcattcatttattatactgctaatacatgataaggtgaataggttaagcatcgtttgtatatgtgtatgtgattttaaacctgagtcttttgaaagattggtcaaagcaaaggataatgaaagcataaagatttagggggaagagtcctctataaaactaagacttaaactttgttatcaacttgaatgtgaagatagaataatctagaaagtgaatgagaattataaataaaaggacaaatcatatatctcatggttgagaaatacaatgagataaattgtatatctcatctcatggagggtcataatgaaagaagtaagagagattgcccttggatagaacctttcggcagacatttcataatggattatcatatttttgctaaactggtaagaatggacttttcaccacattatgaaaaaacactttagaagtcagttgcgatcaagcaaatataagtacctgggaaattaaaatcaaaagcacagcagtccaacaatagtcaaatgcatttactcactctcataccatatcatagcgttaatttgagataatgtctttatggtgtctctttatatatttactcgatttcccatttaagacatttaaccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacagaaattatatatgtttatggtacacaagatgatgttttgatatacatatgcattgtgaaatgattaaatcaagctgattaacataagtagggttttatttctttaacagtgatttatttgaatatatgttgagtcctttctatgtgccagacacagttctaaggacaaggcacacagtgccaaacaagacagaaatccagaaattcatggagcttaaatcatgtagtcttttcagtttttaaaattttcttgctgggcgtagtggctcatatctgtaatcccagtacttcaggaggccgagaagggaggattgcttaaacccaggaatttgagaccagcatggacaaaatagcgagaccccagtctctacaaaaaatttaaaaattagctgggcatggtggcacatgcctgtggtcccagctcttcaggaggccgaggtaggaggttcacttgagcctgggaggttgaggcttcagtgagcagcgattgtgccactgcagtccagtctaggcaacaaagcaagactgtctcaaaaaaggaaaaaaaaaatagaaagagaaactttatttttacattagccttttttaagttgaagaatcccatagctaaaaaagtacacaaatattaatgctgcaactttagtgatttatctcaaggtgaacacgtttaacctagtgggtggtcaagaaatagaacactggcagcactgcaaaagcatcctatctgccctttcttagttaggaccccttccctccactgtcatttaaaagatttcacaaacaacttttggattatatgtatgtcaattctgtgactcatatatatccacatagacaatggagcgttgactgaatgaattcattattccaaggtgctaataatgagcttcacaccagcgggaactctgctgtgtcagttgggctctaagctcagttcatttcagatattcctcactaaacaaaatactgtttttcctcagttgttagtaaaaaatagaaaacagattacattctcatttacttattacttatgaatgtaaaagtaaatattttgcttaataccaagtagccagggtcactgacagagacatgggagaaagaagtattcacatctgatgttatcagacatagaagagagaggtatagttcacctatttctccccactcagtttatacattgacatctgtatgtgtgttgttttgttttgttttgtttgtttgttttgagatgtggtgtcgctctgtcacacaggctggaatgcagtggcgcaatcatggctcactgcagcctcgacttcctggtcccaagctatcctcccacctcagccacccaagtaggtgggactacaggcatgcaccaccacacctggcaaaattttaattttattttactttttaaaatttttgtagagatggggtctccctatgttgccaaggcttgtccccaaatacctggacctcccaaagtgctgggattataggtgtgagccaccacacccagccatgtatatgttaaagcgtttatctgtatgagtggtcagtgtagaaagggcttcatggagcctgattttgatggcttgcaaattattatatttgtgtatgtgtaatcggaaggccttcgccgtgattatttcttcaaaggaaccctttgtccctccagggtgattgtacccatgttcataggaccaaacattgctggttcacataatgactctttttcttttaaaacataaaggacatatttttatggatttttgaggattaatagaataaaaatctaaagtcatattcagattcaagagaactggatcagtttctctgtatttgaacaaaagaatactaatctctaattcataatgcatgaggtctacttcttcctcagtctgaaaatatgaatattccaaaatggtactcaaggcagaggctatatatcaaaattaaaattctgtgatactatgtttttagggaagaagaaaactgtagcattagaaatgtagacgcaaaaggtcagaacaaagtccagtatgtcaagtccctttataatgccatctgaatgaaagacctcacaccatgaacagaggtattgaagcagtttttatgtggaaatggtaggcagcaatatctcaggagtgactttaattataacatttaaggttttatctaacttattataatccttagagaacttctctagctctacaagttattcttggcagaatttgtcctaacatagtattaataaaaataaattttacttgagtatgatataaattactcttaattacaatataattttaaaatgcccaaaacatcttttgatcttatgaatttcagtcagctatgattaagaagacaaccataggcaaaaatttctttcttatggaacacgttggaatgcattctaatcacttctctaagaaaatccctgtcccccatgattatagtgaatatgatacagcaataatttagatgcttctttcaggggggtgaggttatgtattctacagtctattgattctaagaggcacttttttctcccccaatttaacagttttgtttaattatatacatttcaggattttttggggatatttttctatcactggtttctgatttaattccactgtatttagataacatattccgcatgctttcaattctttgaaatttattgagacttactttatggctcgggacgtggtctatcttcgtgaatattccgtgtgtatttaaaaataatgtggactctgggccgggcgcggtggctcacggctgtaatcctagcactttgggagtccgaggcaggcaaatcatgaggtcaggagatcgagaccatcctggctcacacggtgaaaccccatctctactaaaaaaatacaaaaacttagccaggcgttgtggtgggcgcctgtagtcccagctactcaggaggctgaggcaggagaacagcgtgaacccaggaggcagagcttgcagtgagccgagatggcgccactgcactccagcctgggtgacagagcgagactccatctcaaaaaaaaaaagaaaataataataataataatgtggactctaaaatcattcagtggggtgttgtagacacactaggttcttttgattgacagttttgttcctaagccttctatatctttcctaccatggtttgaatgtgtccccaccaaattcaggtgttgaaacaggatgaccaatgtgatggtaggaaaaggtagagcctgtaagaagtgatgggattaggtgcccttttaaaagggcttgctggaggaaatttgtctcctcttgcctttccgccctctgccagttgcggacacagcattcctcccctctagaggatgcatccctcaccagataccaaatgctggtgccttgatcttgggcttcccgttgccagaactgtgagaaataaacctgggctctttataaattacccagtctcagctattctgttatagcagcattgacagactaagacatttcctgacactctgttgatttgctttgatcaattaccgagagaggaatgttaaaaatcttaactgtaattgtggatttgtcattttttccattagttctgccacgtttttgcttcatgtattttgaagctttgttaataggtgcgtacacaataagatcattgtttttctttgatgagttggccctttgattcttatatgcaatgttcctctttgtccctggtaatgtttattctcttgaagtctactttatctgatattttagaatgtagcctgcttttcttatatttagcatttgcatgatataactagcccagtgtaccatcttcatacatttaaactgtgtctttaatattaaagtacaattcttatgaaaagcgtatactttaatcttgttttttaaaaatccagtctgatcatctctgtcttctagatgagttcagtccagttccatgtaatattattattattattatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatgtaatattattactggtatgttgggtttaagtctctcatcttggtaattaattatctatttgtgctatctcttctttattcttttttttctcctttcctgccatcctttgaataaatcaagtttagtgttttaaattccattttatctccttcattggttactttctaaagtggttactttaccactttagaaaagtatttgtttattacaatatgcatctttgagtctctaattaatgtgagaacttgacaatgttatacttctgtttgtccttctgtgctgttattgttatacattttacttctttatatgttataaactccaaaatatattgtcttgttttgctgtgaacagtcaatcgtctgtttaggaaattaagaaagaagaaataaaagtcttctgcttactcacatatttatcattattgatgctttttattctttcatacaggtccaagtgtctatcatttcccttcagcatgaagaacttctttttagcatgtcttttagcaggtctgctggtgatgaatactcttagctcttgtttacttgaaaatgtcaatttcacctttatttttaaaagatttatttgctgaatattctggaccaatctttttttttcttttatcactgtaaaggtgcctttacattgccttctagcttgtactgtatctaatgatcatcagaaacatcatgcttatcatgcttatcaattgttcccccatatataatatgtcctttcttgtcctttgctattttgggattttttttttctctagcattagtttttaacagtttggctgtaatatgcctaaccatggttttatttgtctttatccagcagagagatctttgagattcttggatctgtgggttgattttttaaaaatcaaatttataaaaattctcaactgttatttttttgaatattttttctgtcttttttctgtttctgggattctatgttacaaatacgtaagactgcttaatattgtcctgtaggtcactgaagctgtgttcacttctttctacctttttttctctgtaattcagtttgggtagtttttattgacctttcttctagtttattggtactttcttctataatgttaaatatgctaagtccatctagtgaaatttcatttcagttctaaaatttccattcttttttttaaaagaaaggtatgcatttctttgctgatattgcctatctgttctctcattatgttcatcttttcctttacattattgaccatatgctattagctatttttgtcatttgtgtcattttttttctcagtcttattttcctatttctttgcaggcttcattatgttttattgtacattgtggagagtttgggttttttgtcttcctttaaaacgtgttgagctttgttgtaacaggcagtgaatttactggtggatcacctagttttattaagataggtttagagtagcccttattttaggatgtttctaactcccatcgtgtggtctttctgaaatcacaactgaatgctcacaatgttcagtgatgtctttccaccctggattattacaaattcagtgtctctcagcactatatgatgtctggaatttccatttagctcttagatgcccagaaactgttttctattaggttttgcagggtcttgtcctacactatcacagcttggtatttggccagtgaccagagatgacccctatgtagatttctgaggctcttgctttttgtgtaaagcctttctttgtgatattctgcccattggtgttctctctttgggctctccctgtgtcatgatttggaaagtgtcctcagtcaaaaagtgagggcgaatttagaatttacctaaatcaccttataatatatagccctatgaagtccaatgtcttaaattacatctttaggtattttgtatggtttcacagttgagtatagcaaggagggaggttcagataactgttaatctgtgataactaaaaccagaatttgacattctgacaaacttgaaattgcagtgcttcttaaaattaatacagtattacttaaaaaacaaaaacaaaaaaaccagtgttttccaatttgccaatacaaaaaagcaaaactcccatctctactttttaggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaaggagaatcaccacaaagcaaattaaaagatactgattacttcttccaattctgtgggctgcctagttcatctggcctggcctgctttggctaatctctgaggtcttttggctacttgactggtactgtttgtagctactcagctggtgccctactgctgtttgtctgaagttgttttggctactcagctggtgctagggagcctcagctaggactgcctgtctgtgctccacatggtctttgattttccagtggctggtgcaggcttgtttgcatggtaacaatgttccaagaaagcaagaatgatcattgcaaggcctcttataagctgggtttagaacttgtacttctacctcttcctattggtcagagtatgtccgtaggtctgccaagactcaaagcacagagaaatagatgtttcctcttgttgagtggcatataaaaaaaagtgtggccattgatttcaatctgccacaaccgtaagctctgtgagtacaggaactgcatcactcttttgcactttggtgttgttggcatagtaggcataaatatttttaggtgaatgactaaattaatgaaggaaggaaaacattcaggtagtatttcaatatactgtagttttaaattatatatattatatacatttgacatagtttaatatataagtatatacacatatagttttcatatataagtatattatatattatataaaatatttatatgttatatataaagtatatatataaaatatatagttttaatatgtaagtatatgtatataattatatataatattataagtatatatacttttatcataccatcagtgagtatagacatggttcagggagaatctctttattctccttctatcttttgagatagaccaaagaaaatttttttttaaaaaaagaactatcacttgagttaacattgtttggtatttttatcttcataggtgattgccttgtgaataactcattttgtgtattgtcagaatcctattctgcttttcaggctgtgctatgggtagactagctctaaccagaacacttgggagacctgaagcaaagatactatattaaaataagtaatgttatatgccaaagaggaaaaccacttctgcctcctaaacaactgaaagaaccagagactgtggggtcagattagctagcattactatatgaacctgagcaaatgacttactctctttcagcttcagtgtcttatctaggacattggttctcaggattggtgtgagaattaagagaaatatgtgaagttctagctacagttctttacccatgaggtagtcagtaaagtttacttctttctccatgtgaaccaaagcactgtcatgatgtgatgatgttcattagggtttctcatgctcagcgttattgatatttagggttgcataatgctttattgtgaggggccattctgtgcagtataggatgtgtagcagcatctgtagcctctatacactagatgccagtaggaccacctatccagctgtgacaggcaaaaatgtcttcaaacgttgccaaatgacccctgggggcaaaatgcaaacagtttatctagcagtgacacatagccagccaccttagaaagggaattgtcagcgtacccataagtgtagaatgggaaacaaaatacttgagtcttctcagaatgtctaaaccttttgctgtctatattcctctttttataatttaccacaaacatatattgcttattatgccatctaataaaatggctaacatttgctgtgtattatactcggtgttaataagctttgtatgaactcactagctgaatgttgtatatgtatctgccatacctgttggattgacattccactgtaaacaggtaccttatctttaccagctccaagcacaatgtatttggtatatcaggtagctattctacatgttaattgatcacattgcacccaaatgaaacatggatgtggaagtggaaggaggagctttaaaacatggaaaattagtttatacaaatctaaatgttgtagtgcaccaaattgattcctttttaaaaactttcagaaatcagcttttaaaaaaaaaaagtaactaagccatgatcaacttttctttcatcaccactaagccaatatcagaaagttgtcaatcaacagctcttttaaagttgaaatttttctattgtatttcttatgaagatttcagtagtgcttagaagtttttggctcatttatcatgttttattcactgtatgtcattaattgttaaagatgtcagagtcaaaccttaaattcaggagagatttaaatttttcctttttcctatttaaatatatgtttctaattacataattcagttagaaaattacaatatagaaacatataacttagtaaaagtttccagttactgtatacagattatattgtatactgtattatttttaacagttgcatatttaacttataaatgtggataattataattaaacaatctgttatcaaaggacatacagattatttccagttccttgctgcagtgaatatccttgtacttatttttttacacacttgctcagataatttttaagtacaaattcctgaggtagaattgcagaatcaaaagatactctcatttgagtgtttcacattttatgcaaagtattttgtttcctccagaaaattcctctgtggaagaggcttcctcacattctttatcagtttattagccagcagagaaatgatgaaaagccaccccttttcttgtagtttcatcctcattgctatccaagatgaggtattaaaatcacacctaagtggtgtctgttgtggctgaatataatcttgaaagtagagacacttctctctgattcccaactgtactctctggatggcacctaaaattttattttttcaaactgaaaatcattttaatgagttcgaaaaggttttattttttaaaatgaaatcctatagaaagaatacattttcttacagtgggtcatggtcaaaagtgtgaatatctctgatcctagaaagtttccccagttacaaggacaggcgtgcccccaactccatccttaatggctcaattctgtggctttcaagttaatccactcagtcctacagccttcaccaagaagctcatgtgctacactttggtgttagtgggggcattgtcacacaggttcagaaaataacccattaggcattttatagaactcatcacatgttcagaactaagctagttgtaacattatgtttttcatgtgaaaaaacacaagcaattcactggctattttatttgttgctagctagctatactttctatttctttttccatggtgtgaaaatcttcctagaaacctcactactgggaaaagagatgcagagattagtcccatcttctcccctggaaatttactatcgcccttttggcttcaaggtccttcctcaaaagcaaagaattgaacaagggaaagtgaggggaagggctgggggaacagggaggtagaaggggttttccctggtcttttctaatcctttagttccagacgcttagttggtatttcaacattttagaaataaaacctgcttttataattaatgcaaatattacttagtgattcatcctttccaaatgattcttggtttcttttgacatttcatttttaaattgtgaattaacattgacatcaccatagcgttactgttacctcagctctttacagtgaactgtattgcaaaggctataaaagttcaaattttaactatcacccacgtgagccttggactgctgttaggcttttgaaactgtgatcctttggcaagaattggtgtataaatcatggggaggatattgaaggggaagatcatgtttaatttggcagttgggtgcctgcaattgacagattttcattaaggttttagctatagtagtgatcatgcatcagttctaataaagtaggtttcgtttgaattttaaaaattagagtgaggactgctttatgttaactgtttacattcagaagtctggaaaaccatccacaggtttaaatgtatataatcagtataattaacacgtcaacagcctcacctctgtttttgaggaccataggctaatattatttatgaaggttcaggagatcagtctagatcgacagaaagcttaagggcaaagatggttttaatatttttcttggaagtttgagcttctgtggtattctaaggatagggattttgacattgattgttctagctggtattcagtactgtatttaagtgtaatgtttttactagtattcttcttataactgaaaactatgctaatgattctttactatagatatatactcataaatacgtgtaaaaatccaagtttaccaaaaaatattaagacttaggggatatgttctttgaataggcatttatttgctaattaacatattctaatctcaacaaggttatattcttttcaaaaatccattccatcaaaatctgtcatttttacagatgaagaaacaaaggccacagtgagtttagttaatatccaagatcacacagccagcatgatagaactcttaaatttcaagcgacttaccctctttactctatcaggtcaaatttcccttttttaactgcttgtcttaattgagatttgtttaattgtggctgtctgtatatcttcaatcaatactttcttgttttagacaaatgtttccctgcaaatctgcatgaacttcatgttctgaaggactcagagctgccctttcctttttgttaaagttgtacactgctctgcatccccctagaatgctcatcagctttctcactcttcctcactcacacagtgctccagcaggagaggatttctttgaaaatcagattcttttttggagggctttgtgcttattggagtgttatgtgatatattcattacggtgagggctaaactctttgaacaaagagacctgacagtgcatttgggttaaagaacaaagtttatttctttctctcatcaccaccagcatgagcagcctggatggtcagagcagatctgtctcatggcattgttcagggatcctcattccttccctctcatttatctgccatcccctaggctattaatcatcatgtttttggtagaagccaggtcttctccatgtctgagtttttatggaggaagcatgtcaagggccttaagcccagacctggaagtggtatgcaagagttctgacattgcactggtgagcatttggtcagatggccatctctaactccaacgaagtgtagggtatacactaggtaagcagtcacatttccagctacaatactaattctatggaaaaggagacaacatattttgatgggtagctgacattctcatctgcagtcctaagtactcatgactgctagatagactttatgaaaaaaaaaaagaaaaataaccccaggaattaatatttaccctcagccttgtgtttctttaattttctcatttttcatgtcacatatctaaaatttgatctaaataaatttaaataaaattaacctttatttgaataataataaggacatttctcaaggaagtaaatctcaaatgatatgtgattttagatactatctttatctgaccatgtggttccttgcttctatcagggagggcctctgggtaatagaagattgctagggcctgcagtatattaatgtttagctggagttgattaaatctgagacctatagccttgataataaggacttttatttttgtatttttattgcacttttaatattacagagtttctgtaccagcttgacaacagcagaaacatggcttgcttctgtggaacacgctagagcagcagtccccaacctttttggcatcagggaccagtttcgtggaagacagcgtttccacagactgggggctgggggtgattttgtgatgattcaagcacattacatatattgtgcactttatttctattattattaacattgtaatatgtaattaaataattatacaactcaccataatgtagaatcagtaggagacctgagctgcttttcccacaactagacagtcccatctgggagtgacgggagacagtgacccatctggagacagtgacagtgatcatcaggcgttagattctcataaggagcgggcaatctagatcccttgcatgcacagttcacaatagggtttatgctcctatgagaatctaatgccactgctgatctgacaggacacggagctcaggcagtaatgcaagcgatggggagcagctgtatatacagatgaagcttggctggcttgcctactgctcacctctttttgtgctgcgttatccatagcccagggtttggggacgcctgcactagaggacagagcctggtacactatagcagtcctccccttgtgttatgcagagtactgatcagtcccttttgagcttctcaaccttgtataaaactttgagacagttctgggaccatcacaaggtttatgaagggttagaaaacaatacacttaaggaactaagactgtaaatcgttgaagttcagagggcgataaaaagaaatggcttctaagaatcccagtatgtatgattttttatacaaagcataaagatgatttgtaccaaactcaggacactgtggcgagcttaacacgagggtattgaatcatacgtaagtggtaattcctagattatgcaatctccttgctgttagatttagataccaaagaggaactacatcatgtcctcctcctatggtcttcaaaaaaggattatatttggtcttactggtataatacagtttattcctgcatgaattccatggtgatagaatttttaaagttcattctagtgttacagttttgttttgttttgttttaatacacagcttcagaatggcagaagatgatccatatttgggaaggcctgaacaagtaagtgtcataatctcactgataactttatttaaatatattcatatttcaaaaatatgcaaaggcaacattagtaagttagcattaggaaaattctaaaattagtaaatttttttttaatttcagtttctctgtcctttcatgtgaagttggagaggatatgtcatgtgaaatgagtaacttacacccgctttcacacatattgttgcacaaaaattgtatatgctacaggatagctattgtattagctttctagagctaccataacagatcaccacaaacctgatggcttaaaacaacaaaatacattatttcacagttctgggggctagaagtatgaaatcaaggtgttggcagggttggttccttctggaggctctcaggaagaatctgttccatgcctctcccctagcttctggttggttgctgggaatccttggcttgtagctttatcgctccaatctcttcctccattgtcacgtgcgcttcttcccggcgtgtctctactgtgtctctaaacctaaatctcctctttttttcttccaaaggcatcattggatttagggtacacccttatccaatatgacttcatcttaatttgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacctactattttaataggaagaacagagacattgttttcatatggtgatatatgctgtagtagtagtctgcgcagagcgggatagaaatgttaataagcagcatcactaggtgctaccttggaggaagagcagagttacggaggactttccgaaggaagtcttcgtaagctgtgttttgaaagatgtagtttgctagactagaaaaggtgaaggaacactaggtgccaggatagcctggtcacatttaaattttagtggcaatcatttaaaatagtggatttctgaaattacacgtgcaaagaatcagccagaaaaataaaaacagaagtggaatatgttttaaaggctctggtatcatttctataaataaaatggacatatatagcatttatcacttcgggtgatattctgattgatttagaaagaatgactgcattgcttttcacattaagatgctcctttctaattttatttttaaaatggtgatttaggataaatctaggaacattttcttttattgcagcaaagacatttggctaattgtattatcaaaaccgtttgttttacctttcgcttttaatgtgctttctctaacaattaagggcgaactaaccagcatgaggattgtgtctgcttgattttaaaccatcctttcctgtctgtacacaggaaatcttatcaacaagagatgattctttatgccacagaagagtaaaacctgctgaaaacattcattttgaaagtttttcttatgtgggcatctttgcgatcatcagtaacaggggtggggcatattctgacatttccatttttgaggcaagcggtcttgaagtttttttctttcttggcttgagcttggtggtttatatttcctaaagtttgcatgtcctcagtgttttagtggagtctggaatttgctctccaccctgacctaataaacaatgcaagctgcagcacaacacaacttctctcttagtctgaagtgaagagtatatctctctcctaaggtgagcccttttgcccactcgccagtcatttagccaccacaggaaagagttttcctgctaggttatcacgtttgctctgagactgttaaaatcctgtatgaaatgaggcccatttttgcagaacatggtttttcattcctgtatttccttttcagcaaacaatgaatagcatcagtgagcttttaatcttataagcattgaagtgaagcgcattctttgttcctcagttgaaaatttgcatccctcaaatggatctgaagtactgtttatttaaacgagatttttcttactcttaatttaactaggcatacgaagatcttcagtaccccagaactttcaataatttactactaagggcaggagacaaactgtaatactggctactaaaagaaacgaaaagctagttcagcacacttactagtctctcataaaaagtaaaatatggctggtttccatgctgtccacagacatttcaaacatataacttctttaggctaaaataaatagcaagctcagaaatacagttttaaagtcctaaatgagccagcggttacaatgttttttgataagtaatgaatagtaatttattaagataaaatgtactttcttcaaaatattctgcatgcccactctgttgctgccctaacacattaccacatacttggggcttaaaacaacacaaatttatacttctgagtcaggagctcagaaatctagaatcaaggtgttggcagggctgctttccttcttgcggctctcatctctttgccttttgagcttctagtggctgcctgctttccctgtgcaccctctcatcactccagcctcttgcttccattgtcatacttcctactattcagtgtgatttcctgaacccctctcatcaggcccacctggacaattcaagacactctcttcatcttattatcattaccttaatgacatacgtaaatttccttttgtcatataaggtagcactcacagtttctgaggattaggatgcagacatgtttagggggtcgttattcagcttaacacacccactaaattccaggtattttgtgttatgctaggaaactgaaggtaaaagaaatgagtgagctcagtgcttagttgtctactccttgtactgtcagttatattttcagttattctgtaaatagtcccagaggtgctctctagcattctttcaggccttgacattggatagctagatgaggggtatatttaccaccatagaggaaatactgatttctaggattatattattttgtttatacttctaagagagtacaagcttcaaatcattcattcaacaactatttaagtatctgttctgtgataagcatgtacttggccctgaagatataccagtaagcaagctagaccaggtccctgcctctggggactttatagccaagttatgcttctcaaatccctttgttacgtaaacgttgtccaaccctatgtaaagttttgtacacatgagaactacctaggtctcatgaagatcttttaaaaccctgatttaaaatattttcagatttttgtttttggctttagtttcattcctattattacattttaggtgtcccaacttcaaatttttcatataatataggaaaaataatgattgaaacatttaaatgttcttctttacagatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtacctagaaaggaaatggtgatttgttttaaaaaccaatcttttaacatactttcttgaaatatatttgcacaaaaatatttcatctcaattaccccttgtatggtttactgcatttcatatctgctaggactactcagaaggaatttctttagtcaacataaggattttctttattatctctgtattccttttaagtcctttctcccagattcacacgaggcagtctccactcttcatttctgtttcaaacatttaagagggcctgttgtgtactaccagtgtgccagtcactggggaatcaaagtgtacagaaatcataaaaatcatctcattagaaaaatcatctttataaaagcttataactttgcactctgacaagttggataaaactcataatccttccttctaccatgactgtattaattgtgccgattggcaactgtttaatttcgtaagagtaataaaaaaaaaactctctttcttaaaaaaagtgatttatttgtatgtaagcttggtgtgatggctctttttatgttctgtttctctcctcacttcacccgtcaccagtgggacttaacagatgttcaaaagcagtgtgagtgaattatggaagttatgtgtaaaacagagtttggtaatcgctgaaggaggcatcagctcttttatttaccagggacttgcttgtcttcattgggggactttatcccatttgtattattctcatttaaaattatcatggttactacagtacttacttttcttttgttttagatcagaaaactttttctgcatttatatctttagtatttctaggagttcatgggagggaaaaaagtagatctactatactttcaccttcactagtaaaggtgtatttcagaggtttttctgtctttacccctacaaaacattatttttaggctgccatgtctgagatcttgtgaagtgctgtccaatttgagctctaggtcagcttcctgtgaacaagtaaatgtgttggtagtgtgtgtgtttcttgggaactttttaattctggagttcaaagtatttttcttagtattaatgtattactgaaaatataagaacttggttctgtccacaggaaatacacacattttcacttaatgtcttgtgaatacaaaacagtatcctgaggcagacgttttcttaattttattccttcggatttatgggcatgaaaataagattatcaagataaccatctcagtaaatattctgtggtcacagctttatgttgtagaaattattttgccataatattagaaaaactattcaaattacacctaaaaatctaatttgttagttgttgttacaccatcatttttacctgtatgtttttccctcttcattgcagtgtcatagtacaatttttatagtccaagatatataggatgttgtattcaaatttttaaagaggtagagaggttgattatctaaaccaatattaacttgtaactctaaaatggattattttagtcttctagattttttgaaatctaaaacctttagtagatctagtacttgttgaagactatgggatgcgacataactcttaggtctaaagttaaatttctctgcacagtggaatgtccttttcatggcacagaaatgtggccaaaagaatgttggccttaaaacaacaaatacatgcatatcaaatctaattttctagttgatttaactttaatgtgttgcctgaaagaggaaaaatggctctattttacatgaattttcacatatttaaaggaaattaaatcctacaggaaaaataatagcaaatttgcagttgtttttagcagagttaataaaaagtgagagacttgaagtttaatgtaaacatgcttccaactcctctgtatttttcatgacatccaaatattgctctgttagaggactgtcttgatatgttctttcaccattttaacagggaatgtttttataagtgttacattgtcatacaggctgtatcttagtgtgaaaatatttctatttctaatcaattttatttccatatccaaaattaaattctagccatttggtgggggaatttttaaattatgattatgtttctaaaagtaatttaaaatgtccaggggtgaatttcatacagacaaaagatggtaatttaatacattgaccagtgactcccccttttttttcttgtgtatgcttcatttcagatgcattcatttttcaactcgcttccttgtaaatttcttgaataataacaggaagtaattatacccttgttttctccagttctctagccttatcctgatttatcataatattgaaaagataaaaataaattctctggccgggtgaggtggctcacgcctgtaatcccagcactttgggaggccaaggcaggtagatcacgagctcaggagttcaagaccagcctggccaagatggtgaaaccccgtctctactaaaaaaatacaaaaattagctgggcatggtggtaggcgcctgtaattccagctcctctggaggctgaggcagagaattgcttgaacccaggaagcagagattgtggtgagccgagattgtgccatggcactccagcctgggtgacagagtgagactctgtctcaaaaaaaaataaaaaaaattttgagaaaattctcttttgtgttatagtttatttttaatttcaacctgaaggtttatctccttacaaatttatttaaaataagaggtcttgagcttctttctgagagaaaatgaagattaaaatggacatacaagcattctcctaaaatatttttagcaccaaacatcttaatttgcattcaaataaatgagaaccaccatatgcctttatttattgcaaagctatggattattgtactattgacataaaaatcagctgggaagcttaaggactttttcatattgaacagtttgtacttatgttgtcagagattctgattttcctttgaattttcaagtcagataccattagggtatggattaagcctctagttttctttgcgtttttacaataactaatttgcatgtacctatcttcaattaaattattttcagtattttataaaatgcctgagatgttttagaacacagtttatatgatagcacaatattcaaaattgcttataaacatcaaaagttatggattaatatgaaaattttaccatgtctgatagaccagattacattgggagtgtcggggaggaaaggggaaacaaactaaccagttaaggaatgaaggcagtactttcccttcaagtaaagacgggaacagaaaacctagtgtaaggaaaaagagatagcctgagatcattatctgtctatcagacgtatacatacaggttgctagatcagtatcttttaatttcacattaagcacactctctttgaggaaggaaagtcagtgtctaatgatgtgaaggccaaagaaaatgtcatagtgcccagaagtggttgctgcttttaattggtatttgtcattttaaaatgctttgttaggagacaagattatgaaggctgttgacatcaattcttgccggccatatgccttttattgggttaggaaatgtgccatcacctttcaacaaacatttacttattgtggttcgctaaactcgtaaaactattgttaaaataagggttaatttaatatttcagacaaggaagagaaattatatccttgtggaattttaaccaaaaattgatttgaaatttctacataaaaacataatttcagttttttacttgctttacgttttataccaaatttgagaagcctcacagtttcttttggtttctgtttgttgtttttgtttttagcagatggcccataccttcaaatattagagcaacctaaacaggtaagattaaaggggtgggactttaaatgttagattccagtgtctaatattgagatcataagcactgaagaatagtaaatgagttctatgaaggaagtagtttatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaaactttggggcatggttctagttcttgcaggtgtcacatcctgactcctcaggttgccagtaacactccattgctctacctccatgttcaactcttttaagcagttatttctcagagaaggtcatcaattcccagtgaaattttatcccttaaagttctgtgggctctggcatcctggaaaatttcccagcttttaagatctaggtagtctatgaaacagaaatcaactgaaatttgtctgcatatgccaaagtattttttccaatatcattttcataagcatagcactacaataagaatttttaaatgtaattccttattatggatccaacagttataaggaaaaattggcatttatgatttacctgaagggttaatgtagttccaaaattcaaaatttaattcatataaaagcttatgtgagtaaaacaatgtgtttaccaaagtgatgctattttgatatctgaattcagtgaaagtaagaaggttgtattcaagtcagactttctgactgaatggatgtagccttgcctttgaggttgatgactcattttaagcaaatggagttactgagatgagtgaatgtggattaaaggcaaaattttgatctcagaaatttagaatcagaaatgcatccagacaatgcatttgacgacatcttcctgaaaacagttgtaaattttcatcctcagattaaaaacttctgaggatttagatactcgtatgtaaccatgaaaaatatctattaagtattgtctatttgacaccactcccaataagatataaacacatacgtgtctatatttttccaactgtcccaaaggaattttgtgattaaagataatgaattgtgtgtgtgtggttttggggttttttttgttttttttttttaagttagaaaaagattcttttttctttgggacctcttagccacagattttccccagctctgacggagatgagtcatagcatagactactaatttttagaacatccagttctgttgcatattaatcagtgttaattaactaatactgttcaaaaactcaagttgtgtttaaattagcagtcaagtaaatctctattcttatggttagctaattctgcaggctattatacatgtgttgtttttttcatggttttagaaatttcatttaattatttaaaaaaccaacagtgtttgcttacaaaaggcatagggctgaaattgtaaattatttttaaatatgaattgtgtgagaaccaaaacaaaggaattacctctgaaacttcatctccaaaggcttcccttgtgtttagatctggaatctcccaaggaattgttttaggtctcactgtgatgagttgatcataaactttagacatttgtgtgcattaaggaaatttcccagaccggggaatttactttatgccttacttatctggtaaatgtgtttgaggactgatctttggaaatcaggaagtttttggataatataggaacagttccagatgcttcccagagatttaaatcagttcaaggcacctggactgctcagagactgcaagaccctacttggcataatgaaatgtagtatagtctaagtagtgcatacgttttacatttgttcatgagctcaaagctgtcaaaatctgcatgtttgctggggttccacaatttaatgagtaagggagtgaacccccaccagcagctagtgggtgtgatgagctgatgggcagatgatctagtgctgtatatgcagagttggtcccacaatagaaacaaaaggtgagaatgttccttaaaaaatcttaacgtattttcttttcaccaaaaagtgaatctgtaaaaagaaaatcatctgcttaagcgactatgtggttataaactactaacactaccacaaattgattgacatcattataaagttgaatcaggaaatacagcgaaacctcccttaatatgatgatgaggtcataattatccttgttttattctttgtatacaaatatgaataagttagctttataaatcataaaaagttagaactggagtagaccttaaagatggtctggtataatcttcccttttgtacaaatgaaaaaatatgacacttcttaggtgtttatcagcccacagtagtttatatagtgaaggcttccagctaacttcattaattaactatatctataaaatttctgggttagatagtatttaagggaactacctagttttggaatcattctggtaggttaatattcaatcttgagcttgaccatattaataatcataaaaacaaaaatcttatcctctgaaatgctgagagaagcttaacagatgcagggtctagcacagggtgtgttctacaacgctgaaacagtatatctaaataaacatgtctgtagtccctgctgaaccagctgtaatcagagtagataaaggaatgtctttaagtaagagtcaaggaagcataacttttattaatatggtacagttcagagcttggcagcagcaatttaagacaaggaagctctgactagaacaagccgtaacatgttaagtctaaagcctaaactcttcagcagattactctccacacatgcatagcatgagaggttccatgggcttaggtacctggctttttagccatatcttagtgtacaaatatcgattaataccatttttcgtagtaagattacgggaaaagtgattcttgtttacagagccctctttcagtttcatgtttttcttctctcatttagtagacataagatttaaaaatttgtatgtacctttgttgccgtaatttttaataagtatttctcaaacttaattggcttaacgttcacctttgcagagaggatttcgtttccgttatgtatgtgaaggcccatcccatggtggactacctggtgcctctagtgaaaagaacaagaagtcttaccctcaggtcaaagtaagtttgtggtagctctccttctatttgaattctggaaattttgatttcctacgatttccaaggaattgctttaaatgagtacgggttgccttcgctcctaagctgaagtgttcacatgattattaaaatttttaaatagaaatttgtctcctagcaatagaagtgacagatactaaaactttgttaacatttcaatttagtagaaatgtcttcagcattagctaacaaacttactatttcttgatcatcttaaatatttttaaaaattggatacttcctgaaactttagtaagtctttgaaagaaatggttgattttgactctttggagatttagtgaaaaaccaaacaagtgactgagtgtatggattatatagtatattatttaagattatgaatttggatccagactttgttattagctgtgtagctttgaataggtttaaccaatacttctaaacttcagtctcttaatgtataaaatacaaaaatattaatagtatatacttcataaggtcctttagagattaaatgagaaaatgtgtacatgttccatagagagcctgaaagtaccctagggccttggcctgagcagatgtgtggccctcttggaatgaactgctacgtgacatgctggtggtgtatttggtcataccttttaccatgttcaggctgtttgtttatttgagaatatttttctttaagttaatatgagacttttaatttcataatatgctatgtttcatagactgactgatgataaacatagactgataatcattttgcagataaacgcagtcaacaattgtaatttagttttttataaaagttattatttagtcagtaattcaaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagataagggacaaattatgggcagacaatggtgtaaaaaggcatggtgaatgataactcttgaaaacaagggagagagaggctcactggtcaatgggtactcaggtattggggaagccaggcccagcacttacctttttaacacatgtgtctgtgtgtcacatgtataaatattgtgcctttatgtatgtgtatatttgtgagaaggggattgaaagacacatgttatcagcattgacactgactataatgactgaagaattaactttaagcgaaaaactgggagttttttctgactggcttggcacaaaaaatataaattatggtattttgtttacttctattgctctagtattttgtgactaagtaacaattcttgatactaacaaacacatggcattaactttcttataaatttattggctaagaaaaaactttatacatccatttattcccagtcttcatacatctttctcatgtagaggtttcatctactcaaaaacatattgctgcctcagtcacaaaataatttacaaatgaaacaacttagtgggcattagatgttcttgtagaatgaaagtttctatatcaaggagtttagtacttactgggaaatatagatatgtaaacgactaataataaagcaggttcaactacagtcacattatttcaccaaatcatttattttttattcactaattcagtatccatttattaagcatttaatcaacttgtaagaggaggaggaacttagaggttagagaatatgactatacaagctgtcattgttcccttagcttgtcattgttcactgaaaattgaaatggttctgctgttcctaacagttataggaagtaattttatttatccaagaaattcttaattggaaggatgggtaggagagaaagaaagagacaacggccaggtattttttttttccagagctcttctccaaatatcccttttaatagttatttctgctcaggatgacctttaagtttacaaaggaattttaaatccccttttcctctaatgtttaagcagaggaaaaaattgttctccatgcatctttctaatcaggaagacctttaaaattgtgcatgtcttttctgtggtactttactaagcacctgctcggcgagagactgtaagggaaacagtgggatagatacatctaaagtttctcaaacttggcattattgacatttggggcttgaaaattctgtgttgtgggaggctgtctgacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaatttccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtgggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccctccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctagtggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgtagtttgtactaactcttatagcaaaaaataatattcagagaaaaatctaggggaagtaagtatgcagactaactcttatatcttgtcctttcataagaaaaatttcccatcattaaacatttaataatctattatactgcctataaaatttccctttaaagttttttccattctaatttcatcacggagctcctaataggagaggctggcagaaaagcacaggaaccttcctctaggccaagcttgtccctgcctgcttttgactcagcaaggagtgccagggaaggctcacttccctatttttcccgaaagccacgcgtgaagttttaaaaatcaaactgtgttccctttcacagaggtgggtgacaagagaagcagccccatgggacttcagaaactctcaccaatcctcctctagagtgaccagaaagtaccccttcctatcctaactaatgtgacacgtccttctgtgtggtccactctatgcaaaaccagaaattgacaagaatgactttgattgtaaagtacaaatagcttaccagttagtattcttagtttctctttagttataaatatcaaatgcaagggacttgaaacccagctgatagaagtgtaactatttttaatcaaacattttctgaaagctggttctcacatatgttgtctttcctgagtgttttatgttgagtggaagacgtgttgaaatgtttaggtcaacaacagcttttttgttgtccccttccactactgatttaaaaaaaaaaaaaaaaggctccactcttcgtgcctttccttaaaaatcctaaatgttaagtttctgtcgaggtcgaatagagactacccgatctgctgtggcatttgaggatatcacatatccttgcataatctccctttcctttgtatagacttgtctgattcacgtggtttggatctatttggagtactaatttaaaataatttaacctgactcaattacttaaaacaacaggggagaaaatcaccaataatcagctatgtgtgcgtatagaacctagttcatatcatttattaggatttccattgaacccctaagctgttcactgcgcaagtatttaattagggaaaataaccatacccctatgtacattatactgtgtgttttgtaaaccatgagaaaagctgcttattgaacagaagggctttgtaacctggggtctatggatccctgttggtggtttcagacgctttttagattcctaaatttatatgcagacttacacatgtatgtatgtgcattttttcttgggagatgagtataactttttatcatattttcaaagggaaagatttaacatggttaagaatcatgctatagcttgtatcactttagctttttgatagcagctatctttttaaatgatctatgtaatattttttaagattttttctttttttattcttgcatttttaatcaattttaaatgaagtgaaatgctttatgttgctcaacacatagcccagaaagcctcccttcagttttccagtaggtggaaaaaagatgaaactgaattgatggccaaaagagttgaatgggcttcactgctttttctttcttgctcttccatacatttgcagattaagcatgaagctcaccattagtgattgaagccaaaagagagaaggcaattcattgaacaaatattgattgagcactgtgtgtcaggtactgctctagacaagcagacaaaactccctcccatatgtaaccacaattgagacttataggtaatttttgttgcaagtagttcagaagttttgtattttgtcctaaaacaaaatattactttgtaaaatatttttttaaatagccctctaaatccgctgtatatattcaaagtcactattataaagtggagaaagctactcattagagaaaacctatcacacagataatagctgggaagcttaacccttagaaattattaggagagatatacactccttgaatttaagaactgtctgaattttaaattttgttttgtcagttctggcttggtgaccttcctctattggccattcccatttttctgccctccactcttccttgacacatgattatttctgggaccactgttcaatccgaaacaaatctctggtggcttcttttaaacccagtggtctcagtctgaaggtatagtggggcaactctcggcattccattctggagtcttgacctcataaagtcacatattggcaattcgccttgataaggtcaagtgaacacacagaagcactaagatccccacatgtgttccactgcctcctccacagacaagttgtttttcaacccatctgcaggtccagaggtgaagctggaggctaccctgcagtctcagtcttttctccccaccctccagatggattccaaataagaagcctccagactaccttcacctccctggggtctcatggacatgggctggaaagtgcttgcagactttcacagacaatgctttttgcctttaggtccccttctacccaacagaatgattataataatggcttgatgtgcttacttacatcatctcatttaatcatcacagtaatccactgatgcaggttctgtgatccgcattttataaatgaggaaattgaagcctagagaaattaagaagcttaacttgggtctcacaggcttttagagatggagcccaagatttcagttcatgccatatggtttaagggcctgcactcttaaccatcgtggaataccattcattatcataatgttaaggatctgtttctactttgcaggaatcttttaaatctatggttcacaatcatgggtgggcttcagaatcgtccaaaaatgtttcaaccacagagacgcctgggaaccactgcacaattgctaaatcacagtgcatcatctagccaatcttggattctacaataattctatgacagtttctaagaatacatgccattatataatggcaacatattacaacagataattgaatagatattcaatgtataccgtggaatagaatattatgccactgtgttttaaaaagataattaagaggatacggcacaacgtggaaaactgcttataacataatattaaggataaacctcagctgggcatagtggctcacgcctataatcccaacacttttgggaggccaaggcaggaggattgcttgagcccaggattttgaggccagcatgggcaacatagtgagaccctgtctctataaaaaaaattttttaaagaaaaaaaacaggatttcaaattattgctaatatttgtagtgattacaaatattagcttctttttataaagcctgggtggaagcatatagatgtatctttagctttatttattcatccatgacttaaagaagattggttaacacctgactccaccttgagtagcagaacattggactgaaggaaaaaaaaaaatgtgaagctgtcttacttagctacagtttccagcatgttttctcaggagctctatgggagacagtgcagtgtggctctcaaaccttactacccataaaaatctgcttcaaaacctacttaaaatatcgattttattccatttccaaagcctggtagagtaggtaattctcccactacaatacacttagtaacactagaaaaaaaatataacattttctttaatgcatagctgagtttattagaaagtatgaaaactactggggcgccgtaagacaaaagaaaactttgggaaaacacaataggatatgggtggactttggggccacagctgccctggaaatatttgctgacctagataatcaagaagcttggtttttaacagcttcctagagacaaaagataaggccttgggcctttccaatctgaggaattgaaactgcaatcacccacttaattcaggactctctcagggctatagtttctgttgatgggtgatcctcaggcagagaggtgatgaggaagttgcctgtctcagcctagggggaatcagaagataaaatgcctctcttgagaatcaataactacaagcccaattcttacagattcagagttaagtgtatgctccctgaatagagtaggaaaccccaagtctagaaatgaatatgaagttgttccacattggggataccctcagagccttgcagaaaagcataaaaatgtatgtggctcaaagaatcatgagctcctgatcaaaaattagaaaatatgtatgcaaataagccactctgtttaagaactggcagaacaatgaaaagcagaattaaatcctcagaatcttcagataattgaattaccaattgtttgatatataaatacaaaataagtttggaatagaaaacagaccaggcagaatgaaaataaaaccaagtcgaatttttaaaattaaatgtgcgacactgaaaatgattcaacatagttaacatggataatttgaaagaaaggatgagctggcaggtacaaaagaaggagtaagaggtgtctagttgaagtcctagaaagaagtattacaactgcagatttctggctctacatttacagtttctaggtctggggtgaggtttaggtggttgtggaccacacttttaggttttaaagcattggctctgaagtcatttggttcagggctgggcatgatgttggttcctagttttgcgacttgcagtgttacttaacttggctaagcatcagcttccttatctatgaaactgaaaaaataatacctatgtcataggatatatgtgtaaatcaagttattcagtacatgccacacagtaagcacttaaaaatgacagttgcttctatttttatataaccaaatacactactacaaatattgagtggcagctttgctggttcatttatggattcatggagctacacaaaaccttcaccagtctattaatttatttttagtacagtctctctaatcagtattgcttccactgtatattgaccccatatcctttcttctgtctggggttaagataggagactgagatcagctgtgtcaaaagctttcttttagatgtaacacatgatttcttatgaaaatctcataggtaggataccagaaaggaatttattaaattcttgttaggctccttagttgtattagttttgtagggcagtgttttaatttaggatacttatgatagagagcaccccttccataatcaggagaaacacaagatggaaataaagattttattacttagtggtcctggggagcacacagcactccagggaaggccacacaccaagatcagggagcatgtggagaaagagagagaaaggaactcacgggccattgcctttactgggtccaggacattatccaaacaggtttcccacagggagttttaataggtgggtttcaagcaagcaggtatgagttccaggaggtcacagtgtgatgaagaagaagtcactgtggcatatctgcacagtccatgcgaggtgtgagcatcagtgaagaccagtcaggtaggctatatgtagctggcccatggggaggcgatcaccaggtggcaattgtataatgcagatatctagattggccacatagaggaaccgggaggaggtgtagtactggaaactgcgtcgacggtcactgagccctgctttaggtatgagaaagtccagcttatattcagaatggatgcaaaggcagcataaaattaaaagcattcactgccagctgccataacaagttaccacaaactaggtggtttaaagcaaccgaaatttattctttcacagttctggatgctagaagtccaatatcatggtcttcgcagggccgtgccccctttgaaggctctaggcaataatccttccttgcctgtttctagcttcttgtggttgctgacaattcatggcagtttgtgacttgcagctgcatcattccaatttctgtctccatcttcacatgaatactgtcttctctctgtgtccctgtgtccaaatctccctcttctttctcttagagacctgtcattgtgtttacggcatccataaccctatgtgacctcatcttaactaatcataattgcaacgaccccatttccagataatacaatattctgaggctctgggtagatgtgaattctgggggtacaccattcagcccactacaaacatattgtggcattgaggttataagccagtagccctacaagtataggatgatgcccatttcagcctgataatacactccgaaagagatcacatggtaacattgttgcctcagttaatcatagaaatactcaattagtatagaaataacaagaaaaatgctttgttattctcatgtgtcatttatcgagttcttactatgtatctgttattgttatccttatacacttctgcacaaaagatggttttatcccaagttttagcttagaaactgaggcttaatgagtaacttgaccaagaatggcttctctttctccatttccttcctctcatggtgttgttttatatacataaaataatatatattattctattaatatagattaatatatgtatttatatatgtacattttatatatgtataaaacttatgttgtaagttttatatacatataatatatattctgtttatatattgaatttatatatatataaaacttaacactattaagtcttaacactattaagtttcatggtgttgagttatatagttctattaattatatatatatggggggaggggtgtttctccagcctagacttccactttgaaatgtagtctccaggctcagccacttgtttgacattgccacttggatgtctggtagacttaacatattcacaactgaatttcaaatcttccccaccaatctgctctgcctcatagcttcccctttccggaatgtggttgctccatccttccagttgtacaggccccaaatcttggagttttccttgactcctctcttcttctcaaatcccacatgtaatccatcaggtagtcttattggctgtgccttcacacttttttcagaaactaattattcttcagcacctccaatgctgccaccctggtataagctaccatcctcagcatctttcttccagtggattttagcatccatgaatgattatttcctaaatcaattatcaataattgttataaatttgtgatttttctatttctatccttcctgtcacttttcctggtttttttaaaagagctttcttcattcttctttaaaaaaaattaaaattaacatcagtatgaactcgtggattcttttgttattcattgtactataagccattcctgtcattattcattttgattcttaaattgtcctattcttggccagtgggagtctttcatgctagctcctatgtctttttgatatgtccctatcttttttttcctaacactttccttatttctgaaattataagctattctaggttcaccctataccttcactaccccagtccaggcatcgtctgtctctctaagaagtcctagttccttttagcaggagaagtttttctagactctttcattaggcagagctacaaaattgattattttaaaaatctcgagttcatacactaattcataattctaattccaatccaacactgcaggcttcttccctccctcccctcatcccatacttgtatttggatttgagatatgaaatgtgtatctcatatcccatatttcttcagtaactgaaaaccctcatcatcaatgatagcagcatgcttactcattttgctcagtccaataattcacacacatttgtagaaaaatagaatagttttagaatggctataccaatatctgcaagcttactatattcggttcaaaatttctttgtagttcttttgaccaaatgtattcaacagagagcattcagtcagagtaatgtgtacaaaagttacttggattaaattttttccttctgtgtatttatgtttccattgagctatagagttaagctatttttttatttctattccattttaggggttttcccatccctgttgatttagtaattttattttttgaatatcaacatttgtcagtttcacatctttcatttatatgagattaactagaccctttagaaatcattataaagtcaggttgttctattaatttttaaaataggtgtataaaaaccaaagggatcaatcagagccttgatttaaagtacgttctgaattatttcagacacccgaatccatctaaacccagaacatttcatttgtagatttcaaagacttcttggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgcgcgcgcgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagatgctggagatccctgttttggtagttcagggattcacagcatctcccatgctggtgatgtcaacctgaagagatatttctagtgataggttccagggatctttcaccgaacactttaatatattttatcattgtcctgaatacagccctataaggttcttactaaatttgcaggtgacatgaagtgatagacaacaaacaatttgaattcaaattaattttgaaagctgagacaatggacccaattcttcagcaattatatttaaaagatataaatacatgcagaaaacaaattacaagtacagagtggaagagagatgatttagcagcaacgcatgcaaagagatctaggagttttagttaataacagactcaacatgaaccagcaatgcaatgtgactacgaaacaagtaattcctcattaggctgcattaatggaaacacgatacataagaccaaggaagtggtggtctcatttgcactctgtgatgaaaggccacaccaggaatacagtgtagtactgctgggcaccacatttgtagagaaatagaaaccaacttgagtgtcttcagagcagaatggtgagagaactcaaacttcattcaaatgaggagtagttactgagcctgagaaatttatagcctggaggatttggttgtcttcaaatatatgaatggctgtgatggggaaaaaaggattaaatgtgtcctgttgtcacaagaggatgaaataaggagcggtgaatggaagccccaggcgatagaggtttcagttgctgctgacagtcagggctgtctgaggatggaatgtattgcctcaggacaaagtgagttcattgtcactgaattggttcaaaaatgaccaggaagactacagggcagggaagctaacttgtattacaataagtaatttttttcttttttatttgtatgcccttagaaagatgtttacttaacttgataaatctgtaacaagggataatcaagatttggttataggacaattacaattttctgacagatcccccaaaataatagaaattaatagcttacacactactttatccaagctgtagaatgtataacttacttcatatactttgtgtttagtcagtttatacaggctgaacaacataaagttaagacataaaagggttttttttgcaggtttaaagtactaccatttttccaaattactggctgatcctagaactttgagaaactttggtgtttccccccttcctacttttgtttacatcatagtacgtagatggtacaatattttggttaacctcagtctgacacttagattgtgttctcttttgccctattaatgtctagagtgtaaaaagaccagtaaagtagcaccaagaaatcaaagaaaatttcccagttctactcacttgtaattctcttaatttagtaggggctttccacaggaaatcacaatagaatagttgaaatgctctttatcttatgtactttccttctgaagaaagggacagttaattggctttgttcccaacatggtccaaatttttatacagggcagctgtatttactgtagtacaaaggagattctacaccgaatgatgtctctaagtattttcaataattaagaacctaattgcttctctagccagtgggtttcagtgaaagtgataaaatagattttctaagcaagaaaaatacataatgagggtggttgtatacctttaagaaaaaagaaatcagtgatattcaatcccaagtaaatttggatatcacagagtcagagatattcttaattattttaaattaaatttgagtcaaaaacaatgtgtttaaagactttaaaatcattttaaaagaatgttagaaatttacattaataatttctattttcaatgaataaatgagaaacctagaatttttgttttggacacactttgatcatatctaatgtgttctacttcctctaattatttttatgttattaggatttttaaaaaacctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatcatacttaaattacaactttagggagtttaatgtttcctatttttgcactcctgggatatttttcagtgactcagaagcataaactgacactgtgaagttaaggctgtgttccagtgggaatgacagcatgtctctaggacgctgatggagaaagccctcctcatgcagctgtcttgcggagtctccctgctggtggtgaatgtgagatcacacagggccagcagccagggcagtacatctctgagtctcgcttctggttttacctagagccaacccttggtgattgtttgcctccttggccaagcccccacacaataggaaaactgtgtctcaaggtcgaattctattaatacctgagaggtgaatttataaacatttaagatgttttagcatctctgcagccagtgtctctgtaaatgaaaattgcttctcgaagtagaaaagcataagggagtacaagggcttcaaaaaaaaatccttttaggaataagaatattgccagggttaggtgttcctaactggtttcaagcagaggagttagtaaaattccaaaagttaatcagcttcatgtactcaacttttgctaggactttgcagaaactcctcagggatccctcagagttagattagggagatgaaccctgccaaaggacagtaaccattcaacagctggatagcctgttgggccccactgtcctcagcctttcctaatgttgcctgggaacaccacttttctgctccctcctttttcagtgtagcctggagacaattatttatttattcactagctcttttaacaaatattgattaagtaggtactggttctgttctaggggttggaaaaacagagaaaattaaatagtgcctttgtcctcaggaaacaatccatttaatagagagacgaagatatgcccttaaatacctgaatcaccagcataaccagcacctgcggctgccatgtgggaattgttgaacaagataatttttgaatgaaagagtaaatgacctaattgctctaatgtaaagataaatttctaagagtcggctagttgggatgattatagaaggattcaagggagagatgtatgaaagcatagatctaacgagagaaaacagcacagcagaaaaagcagcaaaggctcaaaagtagaaatctctgagatcgaatggagaatagtaaataatttgctggaatgaagagcacgtggaaggcaagggtggtaagaaggctggagatagtagataaggccaaatcatgcaaggatttaaactgtatgtttttagaaaatgggtaagctatagaaattttatataggaatgagaaattatcagcagcattgtgctttaggactacaaatctggtagcaatctgctaactgatattggaagggaaaggcccagagacactagttggaagaattgcagtgattcttcatgagctaaactaagagttcaagctaagatagataaactaaggaatgagaatggaagaaagggacaaactgagatttttggggtggtactcagctgaagtttggcaactggttaaacataaaagacaagagacagagaggaatccaagatgaaaagacgattttgctgcacttttttagaaggcagcatttgtatttccatttccaggaggtggagtagctttgagaagaaaggtgattagttcagttttgggcacattgagctgtaacggtattatggacaggaagataccctacaaacagctggaaattttgcacatgcttaaaaagaagatgagaacatgagatttcaatttagccatcatctgcatggagtagacaattcaatccaggagacttgataagaatgtcaagggagtgatcacgataaaggtgagaaatggactgagcatcgatctctgctgaaacatctctttgagcaggaagaagagtgccttagcaaaagcagccagtgaaatggggagttgggggagactttcaaggagggaatggtaacatatcccattcccaaagaggtcaagtagggttgaggaataataaatggctagtgggtttggaaacatggaatctgtcatgacctttacacactttttcatttgatggatcgggggattacttacatttgcaaagggcctcagattaagtggtaatggttcagcattagtaattagagattttcttatgtactttgtagggagaaatagaatggcattcaaacaggtttaagttcctcttaagaacctttctcattggattgtagagaagagcaaatgaaagaatcgttcagtatttcttggtatcatgcccagcccataggtttcaattaatgttaacctttacagttgtcatcatcattatccagaaggggcttttttttagaataaggaagaaaagcagtgctcatctgtagacaagggaaaaaatcctttggaagagagaaagagaagggtaattcaagaagatcaggaataaacattaagggtaaaaacagaatggttagccctggaaaagggaacaaacatgtttctctgaattaggagaggatatgtgaagtaacagggatgttttgagcctcagtaacagtaaggagaagagagagtgaaggaacttgcacgcagtgacttctaccttctcattaaagtcaagagagaatctcaactgcagatatctgcttaaggtaggaagagagaaataagaattgctgtcatttattttgtggttttgatatagcaaaaactgtactagacactttacctcctttaatcctcagaaaacttagagattatatatttgtattcacattctacaaatgagaaagcaagtaaaaaagttaagtaactctcccagagtcccccagatggtcatgggagcccagattcagagccagctatgtcttactccaaagcctgtgctctttattgaaacatactccactagtttgagatcttggaggtgtacccctgcactactatcaggactacccctgataaagtcctgtggggtagttgttcctatccatcaccacagtgaatatcaaagaagggccctctcatttgaggaataacagacagtgaaattgagatggaccagaaatgcaaatcctggatccctgagggaaacaacaaaatgaagcatagaggaaatatctgagtctggtgccaagactcatcagtacaagagagaatgcctaatgggcaatagcagttagggtgggaaaagagaagtacaagggggtgtcttggaatttgagggaagaactgctgccttagttttcgaaggatgattattcgagagttgccctcccttcactttctcacagctggcagaattcctacctcttagtggttagattcctttttaccagatactgtagggccagtgcagcaaccagagcccccagccagaaaccctgcctccaatttagaccagtgttctgctctggtgtgtaataatcatattctaatttaaatagcctattgagatgctacattgatatctagccttttttttttttttttttacttttaagttttatgtgcaggatgtgcaggtttgttacataggtagacgtgtcatgggggtttgttgtactgattatttcatcactcaggtattaagcctaatatctgttagttctttttcctggtcctgtctgtcctcccaccctccaccctttgataggccccagtgtgtgttgtttccctctatgtggcaatgtgttctcatcatttagctcccacttataagtgagaatatgcagtatctgtaataatgggttttctgttctcgtgttagtttgctaaggataatgacctccagctccatccatgtccctgcaaaggacatgatcttgttctttttcatttctgcatagtattcaattggccattttttaaaagacaaaataacaaaaaaaagagtacagttatctccactcctcacccactacctgccacctaacccaaccctttatattttagtaattgccttccataaataacattttatcctgtcttaattatgcattcattagtgtattaattattgaatgcccacaatatgacaagcattatttcaagcactgaggatacagcagagaataaatcaatatcctcactgtttttattccatttttttaagagacagggtctcaccctgttgcccaggctggagtgcagtggtgcgatcatagcccaatgccaccttgaacttctgggctcaaaggacactcctacctcagtctcccaagtagccggaactacaggtgcacactaccacacccagcttccccactctgagcctccatcctaatggagaagagaggcagtaatcaaaatacatgaaatgtgtagttattagatggttattaatgtatagagaaaaattaagcagagaaaggagcaagggattagggggtcaaagttttggtaggggtagagtggtcagtgaaggccaccttgagagatggcaattatgtaaagcctgaaagcaggtaagaaatatacaggtatacagatgtccctggaaagagtgttctaggcagaagaaatagaaagtgcaaaagctaagattgctcacctggcaagttcaagaacagtgagaaactgatgtggctgcataggagtaagaagaaaaaggacggagaggacatgagatggtcagatagcctagggccttgtaagccattataacgattttgtcttttaatatagagaaatattaaaggtttttgttttaactttttaacatagaaaaatgtaatcgtatacaaacacagaatagtataatgagcccccttgcactaatcactcagctttaacagctttcactttgggaggattttgagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacaccttttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaaaaacatgccattaatagtgggtcaaagaggatttttttcatgccatcccctaccttactgagaataccacatttatattcagaagactcataatgaattccagagtcctctgtgtcttggctgtatgactttgggttatgtcactttgttaatctgtttgaacttctgttttcttatctacaaaataggggtaatagagtcaactctgcctccctcacagggactttcggaggcccaagggtctttacaaataatagagaaggaaagaaactggcactttaatagtacctaccatgtaccagggactgcgtagtccccacggcagccctctgaagtcatgtgattggcccattgtgtagatgtagagcttaagactcagagaggttatttaatctgtgtaaggccacagagctaggagggggaaaagctgggattggatcactgactagatcaacttgaaatctcctgcctgacagagaaagaagagactaactttactaagcatctttttatgccagaaactgtgttggacataattctgtactatcttatttggtaaaggtcattctgtccttcctggttgccctggttgctcaacaagtaataaacaataaagcctgactgtttttcatccctgagagaagaaatattattaaaatagcgttattctctttctttctttccttttttttttttttgtgtgtgtgtgtgtgtgcgcctgataatctgacttgcaacctcacagaaaagaatgaatgcatggtttcatgtctgtggcatgactctgtgaaggagccttgcaaggggacagatacacctctaccacttcttatagccattcctgagacctctcttctcacaacacataccagcaaagccaaacaaacaaggtgtttaggaataactgtcatctatcaacactctctaggcaaagtagaactatgaaacactgaggagactgcacacacacagaagaaaaaatgatcatgtcacatggtagcacagagcaatgggaaatgtgaatagtttgttgaggtggacagacccaagctcaaggattgcctgatcgctccatttataggaaccatggcaacctaccttatcttactgagcctcagttcctccagctgtgaaatggggtacaacctctgaccccacagggctgttgtggggattatctgagttagcatgttccataaaacacagtaagttagaaagtatagctgtataggctctgggagtttaacaagcaagagaaatttgacagtaatcatttagttactgaaccctgtcttcatattgcgctaggttgcatatggttttcctgcctgtcccttccaatcacatttcagaaaaaggaggcagtagtggagccttgtgggctaaagtggtgaggagggtgtcatggaagattcaggttcaggtcttcctcttgaagaatgggtgcttctcaatagggaagtggaggaacaacctgggagttgtcagcttgaagaaaatcctgagacgtgataatgggtaggtccaaggaggtcctgagtaggactctgagcacagagcctttctttgcatgtgctgtttttcctgccagcaagaccctctaaaccctttggcctcacccacccccttgcctggttatactcctagccttctttcagatctccaccctcagtactccctcaggaagctttccctgacctcctgacccagtcaagtgcttcttatatatctcctttgtaagctcttctcagttacacttttacatttatttgtgagattatttgattagtgtcagtcccactctttaattctccacaagaacagagattgtgtctgttctgcattcaccatgcatcgcttcatcccctagtttactgcagtgtgtggaacataggacgggctttaaatactcgctgaataaatagagaaatgttggttattagtgaggtattacctaggtgggagagaggatttatatttgggattgctaatcccattaagtgccaagcactgcattaactcatttaatcctaaaaaaaagtcctatgaaatcaagtgtattattccttttaactttaaagacagagaaactgaaatccagagatgttaaccatctttccccgttgacacagctaagtggtaacagtcggtcttgagccgggcagcctggcttcagacttcctagactttaccacattgttctgctgcttagtgcagtagaggacaaagtgaggtgcacacgtgaagtcaggacagatttccgtttgaaaattgtgtattttcccctcctcttcttcattaccattgtcatcatcatcatcatcaatcacttcacaagcaaagctaagcagaaaagaactacttcatgtatcacctcttacattcatgttaactctacattctgccaaagtgatttggctgaatttacccaaagagcaaagtggacatttcaaatcctgattcctagaaaattatagactacatcctgtaaccacctttgaagaaccagcatgtactttaccccaacgtgacaaaattgttttaaataaaaagaggtaatttgactaagattggtatgatctgagacccatggtttctacatcttattcaaaaagcagatccagcatgtggtcatcagtaggtattgagtcataaagctcctggaagaaaatcttaagtttcatcaagaatgccaagaagtcctgggtgtctccaagaatgatagctgttactataataacataattactactggaaaattagcaaagcccaataaaatatggcatgcaaaaaaatatttaccctggaaatagaagtgacctaaatcagtcgtttattccagccacctgcttttagatagtacttaaaaaaaaaactctcaggatggtcatattgtttaaagttctctaggtggaagagtactttacagtaataaattaataaataagacaagttaatgcttttaaactactattatttgttgagcattgttgtaaaggctttacatgcattaatgtatttagtcctcacaacaaccctttgagatactattatcatcatctcccttttacagatggggaaactgagcagtgcccaaagtcacacaaccaggaaatggggaactatcttcaagcccagctggtttgcgcctaaagtccatgctcttacagtgtccctgggtagctgagtactcagttttgtcacctttgtctccttgactttaactgaaagcttaactctttttttttttttttttttttaaacggagtcttgctctgtcacccaggctggaggggcagtgtcttgatcttggctcactgcaacctccacctcctgggttcaagtgattctcctgccgcctgccgaatagctgggattacaggtgcacaccaccatgcccggctaatattttgtatttttagtaaagacagggcttcaccatgttggccaggctggtctcaaactcctgacctcaggtgatctacccgtctcggcctcccaaagtgctgggattacaggcatgagccaccacgcccggcccgaaagcttaactcttaataagagcctgcaatgttcagacgctttgaaaaaaacctaacagacacagttgctctctataaacttaattttcaaaggaaccactattcaaagaagtaaaagggagactgaataaaaagaactaagttctccgtagagcaaatgaatttctgaatcgattgcaaacagttctccgtcatcatgacatcctatgaagtatggtctcccccatgttagagtgccagtgtcttcatgtaccatataacttgcaaatagtatcactgtcttctcacacttcagctttcttctttcatcagtattttggaaagtccacaaaacccagggggctccctgtctgttgccctgtggtctctgtgaaaaccagatgatgcgatgctgacttggactctttcaaatggatccaacagcacatgagtcactggcagcatgttcagctcctttacctcaggaattacccagttcctcattcttgccacccttcagccgtgaagtagtaatatgaaaaatacatgagtactttttgaggatacctcggacctctttccttcagtaccagagactaattgcctcataatggtaacattgaagagcccagttatctgacgtgattgggctttaattatggattccttctggtgtcctattaaattggaaagcctagctgatttcacccaaatgaagcattacctcatgccttgctctcttgcattcctgtgctggtgtcacttaaaagtgtaattacatggtttatttcgtgttctttcactcttgatttattgctgaagaagcccctgtgggatatatcatcataacaaagactgatttcagatgtcaacaccaagaaacacaactggcatcagcaatctatagagagtatctagggacagcagtcagctttggagaaaacccagaacttctcattccccatcccacatttaagggcaaagactttctccttgttaaagggaaagcactgagttcataattagctttatacccagagttttttttttttaaatgttatacctgtttaagaaattttttgtgctttgaggtggtcaagatcaaatttaattagcaaccctcttcgtgattggcttgctctggggaccctgctctttgagaaggaggttagaaggtttagaagcaaacctttgcagcagttctagccaagtgcatgcatacaggccttgaggtggagctgcacagttgactgtaggggagtctgtcctttgttgacgagtgaaacttctctccctgcaaaccctctggggaataatgccaactctgatcagcttttcgactcttggatgaaatattgggttgggaaaaagtccctactaagaaaattgtaccaaaaccctgcttcaataaaatatgaatccatttaatgaagtttatagtagaagtaggctagtcgaaaaggattctgtctctttccaagtattattggcaggtttagggtcttcctcaagtttatatcattaggacttccatcaaagagttatctttaggtgtgattcccatcctccctccctctctccctccctccctccgtcccatcgttccttcctccctttcctccttccttttctacctttctttttctctctgtctctctttctttcaagctgtgggctgcttgtacagatttatgcattttgaattactgcatagttgagagatttggggcttaggttattcagttcttcaaaaagtacagtatgagctaaggagatagggtgaccaactaatctaggttttggctccaaaaaccctgtgtcccagaaaacccctcagtcctaggcaaaccaggatagtagttcatcttgtgaggagattatagtgcatttccaagtatttagctgaatttatcacagggctctgacttgataggatttaagagggttaaaataaggtcttttctgttatgttagtgtgactttagtcttggcactttctcaaggaaggaatccagtctactacaggggctaggtgactaaggagaagaaagaggatatctaagtgttttttgctaaaaatgtcattatctccatgctatttcctttttattgctattgtcatcattttaaagacataccaataagaaataaattactttaaatagaaaactctaattttatcaagcaacagcaaacaggggtgaaatctaaggatttgtacttaaggagtacacttttttgaattgaagaaacttactatgacctgagcatatgtaactcaattatcagaagtcagagagggctactgaaggctcaggttttctaagagatgactggaggccaagtcctcaggcttgagtgtttatagccaaacttcagaaccaggtccctggcaagattctcctgtctaatcacatggcacagagttaggatggactgtttctgcttacctgccttcttcctttgatttccatcaaccaccagtttctttctcatcaatcatttacccagcttttgtgaccaagaattttgatgaggatgcagaggaaggcatgttcttggttaataggaaaggaggcttcatgacaacacagcatcctctaagatgtgttgctccaactttcacaatacatattgtgttttaagtggcctgcttcttggagtgtatcttcccactacacaaaacaaccaccattaacattttcatttacttccaccctgtcatttgttcatcacatacttttaaaaacagggctgtaatcatgtatatacatatatgaataactttatattgtactttttatacttactggcttatcataaacatgtttccatgttgctggagagtcagatatgctaacttttggaatgtgcttcttatatagatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcgggtaagtaggggtatatgatgctgtggaaggtaggaacagatagaatatgggatgcaggaacttagaatgaacaggcccctttcattagggacctttctgagaccctcagatgacctcaaaaaactgtgtaaacttgtgctttcatttggactccaggaagtaaggtgaccacatgtctggatttgcttgagacagcccagtttgcccctgacctaattgtttatagcaccctcttctactcttaaaggtggcccaatttggatgatcacttatatgtggtcacttgacctacaaggtatttgtgccactattaattttttttctcctagaaataaaaataaggacaaatttaaagaaacataactatagcagaaatcatcactttatgtatatttttacattcttgatgatttcttcagtggatttatggtgtgaatatgtagggctttaagtgaatgcataaatatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacatgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccagttcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtggggtgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttacaatgtttcccaaaatacactatttctttcataattcatttgtttctatctctctctatatatacatttttaagattttcaatgtcaaaacttattgcatttatgtagaaagaacatcgtgctagcattctggaaaccagtattttattcccagtactgttgctctcaacagaggactgggggcaagttacatgacttcttggggaccttaatgtcttccctcataaaatgagagagtttcactacagaatcttatcttcaggctgtttacatctccagaattctggactgaactaacattacgtaatattatgaaataacatgagcaaacttgccacacacatatttatggtatgacattgattattagtatttagttctgacttgtagataagagtatcacatagagaaacttaggaagatagccaaaattatgtcttagacttgtcaatactagaaatgaagctaagataacttgttttcaataatacagattaggcaaagagtatagattcacaagcaagacactaatccaacataccaaaaaagatatccaaaaaatggcaatgagaagacaaataacttttaaattgtcaaaaccaaaagaattactttctttggagtgtttatcttcatctttccctcagtatgaattcttaataaacttagtttctactttcaaaaggattttatctatgttataaatattcatgttttaaatagccaagtcttgattctggtttgattgctgtaatgtaggggatttgtcattttaatattttttaagttagctttaattttgtcttttttaaaattcatttatataattagcctttactgcctttcttggtaaaaaataataataataatcttagtttggtgttttattttaaaccctgaatatcaacaatttgtttcaacatattttagttcgttgacatttttattccatggaaaatatctgtgttccttgactttgctttaggccagttcacttaccagtaatcaccacactctctctgctttctggcagtttagagacatggaatttttttccaattaatacatatagcatataccaactggtaagcactaggagtagatatataaatatcaaaatacagaggagaaacaaggccttcttcagtgtctgttgttcccctttttgtccatgagttctcatcatttagctcccacttacaagtgagaacatgcagtatttgtttttctgttcctgcattagtttgctaaggacagtggcctctagctccatccatgttcctgcaaaacatatgatcttattcttttttatggctgcatagtattccatggtatatatgtaccacattttctttatttatttatgttattgatagggaatttaggttgattccatgtctttgctattgtggatactgccgcagtgaacattaacatgcatgtgtctttatggtagaatgatttatattcctttggttgtgtacccaacagtgggattgctgggtcaaatggtagttctatttttagctctttgaaaaatcaccacactgctacaaaatcaatgtgcaaaaatcacaagcattcctatacaccaataacagacaaacagagagccaaatcatgagtgaactcccattcacaattgcttcaaagagaataaaatacctaggaatccaacttacaggggatgtgaaggacctcttcaaggagaactacaaacccctgcttaatgaaataaaagaggacacaaactaatggaagaacattccatgctcatggataggaagaatcaatatcgtgaaaatggccatactgcccaaggtaatttatagattcaatgccatccccatcaagctaccaatgactttcttcacagaattggaaaaaactactttcaagttcatatggaaccaaaaaagagcctgcattgccaagacaatcctaagccaaaagaacaaagctggaggcgtcacactacctgacttcaaactatactacaaggctacagtaaccaaaacagcatggtactggtaccaaaacagagatatagaccaatggaacagaacagagccctcagaaataataccgtacatctacaactatctgatctttgacaaacctgacaaaaacaagagatggggaaaggattcctatttaataaatggtgctgggaaaactggctagccatatgtagaaagctgaaactggatcccttccttacaccttatacaaaaattaattcaagatggattaaagacttaaatgttatatctaaaaccataaaaaccctagaagaagacctaggcaataccattcagcacatgggcatgggcaaagacttcatgactaaaacaccaaaagcaatggcaaccaaagccaaaattgacaaatgggatctaattaaactaaagagcttctccacagcaaaagaaactaccatcagagtgaacaggcaacctacagaatgggagaaaatttttacaatgtatccatctgacaaagggctaatatccagaatctataaagaacttaaataaatttacaagaaaaaatcaaacaaccccatcaaaaagtgggcaaaggatatgaacagacacttctcaaaagaagacatttatgcagccaaaagacacatgaaaaaatgctctcattatcactggccatcagagaaatgccaatcaaaaccacaatgagataccatctcacaccagttagaatggcaatcattaaaaagtcgaaacaacaggtgctggagaggttgtggagaaataggaacacttttacactgttggtgggactgtaaactagttcagccattgtggaagacagtgtggcgattcctcaaggatctagaactagaaatgccatttgacccagccatcccattactgggtatatacccaaaggtttataaatcatgctgctataaagacacatgcacacttatgtttattgcagcattattcacaatagcaaagacttggaaccaacccaaatgtccatcagtgataaactggattaagaaaatgtggcatatatacatcatggaatactatgcagccataagaaaggatgagctcatgtcctttgtagggacgtgggtgaagctggaaaccatcattctgagcaaactatcgcaaggacagaaaaccaaacactgcatgttctcactcataggtggaaattgaacaatgagaacacttggacacagggtggggaatatcacacccctgggcctgtggtggggtggggggagggatagcattaggagatatacctaatgtaaatgctgagttactgggtgcagcacaccaacatggcacgtgtatacatatgtaacaaacctgcacattgtgcacatgtaccctagaacttaaagtataataaaaaataagcaagtttacaagggcaaaaataaaacaaaaaagaaaaagcaccacactgcttccacagtggctgaactaatttgcactcccaccagcagtatataagtgtaccctcttctccacagccgtgccagcatctgttatcttttgactttttaataaaagccattctgacaggtgtgagatcatatctcattgtgttttaatttgcgtttctctagtgagctttttccatatgtttgttggtggcatgtgtgtcttctcttgaaaagtatctaaaacagtcacttatcttttaaagaaactttttaaatcagaaaaaaggtgtttatatttaaccacgtatttatcatttgcagtgctgttcattctgtttcttaggtcaaaatttctatctggtatcattttcttctgcctcaggcacttccttttattatactgctgatctgatgctgattaattctttcagtaggtgtatgttttcatagctttttattttatctttgtttttcaaagatattttgaagagtatagaattttaggtagacaggccgggcgcagtggctcacgcctgaaatcccagcactttggaaggtcgaggcgggcaggtcacctgaggtcaggagttcaagaccaacctgaccaacatggagaaaccccgtctctactaaaaatacaaaattagccaggcatggtggtgcatgcctgtaatcccagctactcgagaggccgaggcaggagaatcacttgaacctgggaggcagaggttgcggtgagccgagatcgcacaattgcactccggcctgcgcaacaagaaagaaactccgtctcaaaaaaaaagaattataggttgacagtattattctttcacatccttaaactatgttgttccactgtcttctgatttgccttgtttccaagaagtcacctgtcaatctaatctttgttcctctgtatataatttttttttctctctagcagcttttcagattttctcttcctcactcgttttaagcaatttgattatatggatattagcatagtttccttcatgttgcttgtgcttggggttcatcgagatccttagatctctgggtttatatatttagtacgttttaaaactttttggccattattttttcaaatatattttctgtccactcctcttcatcttcttctggaaccccagttgcacatatatttggctatgtgaaatttcctacagctcactgatgacctgttttttaaaaaatcttttttttctctttcattttggaaagttttattactgtgtctgcacgttcaccaatatttttgtctgtagtgtctaatatgttcttaattccatctagtgtattttttcctcttagacattgtaatttgcaatttctatagatttgtttggggtctttttttttcatatctgccatgttactccttaacataccaatgctttcttctttttctgatcatatggaatatataatagctattcaatgtacttgtgtacaaattctgtcttctggatctatttttgtttagtttttgtcctaattatgaattatatttttctatttctttccatgcctgttagttttttattggatgacaggtattttgaattttgtatcgttaagtcttggattcctttttttttttttttttttttgatgtgcttttaaatacgtttgaggattgggatgaagttaaatttgggaacagtttgatttttttgattctttctaaacttacttttaagctttatcagagagaccagagaaacctttactctagggttaatttgacatcattgctaaggcagtacctttctgaattttcaacctgatgctccatgtattacaagatttcttgaactattccagccccatatgtgttacaataatttttctgcctccacctctgtggtggttcttttcccagctttgacatatttcctcacacacagcactcagctgaagactccagtgatctctgagtgtatctctgtttgcggtttcttcctttccggtactctgcttgtgagttttagcctccttggcttcctccaatatttaactgtgtctcctcaacctcagagattgccaggctctgttggggttcctccttcctgtgctgcagcctgggactctttaggcattaagccagagtaattacagggttcaccttatttatttcccttttcttaaagattactgttctgtgctgcctgttttctagtgtctaaaaaccatttcttcatgtattttagatatttaaggttcaaaccagtctgttttactctatcgttacctgaagcagaagactgacttctgtactgtttcatttgttaaccagagtaaatccttcattattcacataataaattaataaggatgatgtttttctcacagggactagattaggcaatatacatgaaaagcatattattgacagtaaagtgtaagatgctacacagatgtttatcattgctattacaaaggagataaccccgttttcctgcagttagggaagttctatatgggagtaaggctgaaagggccaaaagatataggtattgtttctgaaaaactgcctatgcttctatgcatataagtatgtcatgttgcatatttttctgtgctgtattaattcatgcattcctttatcaacagatacttattaaacactcatatgtcaggcattgttctagggactagagatctctgccttcaaggagcttattttctagtggtatattttctgttctgtgtcttagctatccacttttttcatctgcctggacacgtgacttattctgtctctgggcctctggtatgagtgctcatttcattctgccttataactcctattttcttccctactttatctgaccttcctaccttagcttgttcattctttccttcaatccagttgtcatgaaatctctttctttcctctactaattttttttttctttctttctttctgagtaaaagccagagatctggccccctgcttacctctctgaattctttacttacttctgacaacttgctcatttcactccagctacattgacctccttgcctttgttgtgttttgaaaacaccggcgtggtcctaccgcaggaattttgtacttactgttccttttgccacattcatcattcatatgttcatgtcttccccatcgcttccttcaagtttttgctcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctgttatatttattgaatagacttctttgtttcatgtactttaatttcaaaagtgaatggctggaacattttatatattttcttataaatcattttcattgctttttaagcttatcacatattttgttttataaatatgtagccttcgtgagataaaagattctccatccctgtttacgtgtatacttagatgacaactctaatggtcataaataattccaaccttatagataactcaggagaagatgagattataagtagactttaaatcccattcagaaacccaaggacaattcaaaaggaaaataatcattccaaatataatattcttcttattcttaagaagttgttagtattttgaattttgaatttttaatacagctcccatagaaaatactttaaaatgaacccggtaagacttcctcattaagacatatagacacatatgctcccactcccgtaatcaaatttggaagtcaaataagctctgaaaaccaaaacattcttccaagtttattgcagactcatttggtagtaaaaaccaatctgacctgatgtgtagctgtttatagtctttatttttccatttggtgagtccaattatatatttcgctgaggaaatactaacatgtttgactacattgtgtgccccagacctgcttagagtattatgtaatatgcagtataggccatatattgcctttttaacatcaaaaataccctaaattctgaaatgcatgtagccccaagagatttgtataaagcattgagggcctgtgtatttttttttaatttacaagtgaagccagattccctagacattaagtgcctaacttttggttgttgttgctgctgctgttactgttttttctccagcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggaggtaagcatcattttcctggccttgatcctccaaggggtccaggctttggttttcatctgtatgaattatatgttcatctgcatcccttccagtctctaccccacactgctgtcaccttttccttgctcagaaacctttgatggcatcctgctacttctaggataaaaactatagctccatagcctgtcatacaaagccctgcttctctggccccagcaactttcagcctcatctccagcccaccttgcatcctcctctcgccatctctgctctctgaataactgaggcatatttatacctttgtatgtgtcttcctttaccaaaaacaccccaccgtttccatttcaccctctcgaaaaccaatgcagaaatcaagactttgtctaaagaacacctctgttttaccttccccaactcaccttattataaggcatttttctttctttgggctctgcagacacattataaactattatctttatcataaaaattgtatgattttccattttcttgccttttctcaaatttttttttcaaccccattccctgtcccaccacatgccccatttctacttttgtattttgtcctttactctggccgtccagtcgtcatctgatactcatgtgattcaaaaccgattatcagttttccactaaatatactccatcttctgatacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtagtgagtacttcacttccaacagggggcacaccaagaatagacttccagccctgccctgccatttacttgctagctgagtcctggggaaggtaacttaatcactttaagcctcagctttatcatctgtaaaatgtgaataggaaaatctagcttgaaaggttgatgtccaggttaaatgaggtattttaagaggggctcaatacatgtaattctttttcctttgatgtacattttttagtcttttacatgaaatgtcacatctcatcttatttatgaatgtcttgctataaagatatatggttgatacttttagaagggagaataatcccaattttctttggtggtggggggactctggaaaggagtttataaaagacaactattattcttacccattttctttcccatatgttactagctttatcaagagagaaacttgaagttaaatgaatgagtagcatagacagcatgtgacttcaaaatcctatttcaagccgggtttggcgtcatgccctgtagtctcacctacttgggaggctgaggtgggaggatatggagtttcagcccagcatgagcaacataatgagaccctatctcaaaaaaaaaaaaaaatatatatatatatgtatatatatattaatttatagttcctaggactttttaagagttttacagtaaccttcagcatttaccatgcaactttcttgtttgattatgcataggattgattagacaggtattttcaaaaagcctgcaagcatagtactcagactcattgaaagtttatagaatttggcctgtgtggaaaactctgtgctccaagtacaacaactaactgaattctctaatttaaacaagtttgaagggaagtgaaaggttataaaatgatacagactcataccgcagaatcaccttaaaatgcagctgttggagaaaaaaaaaaaggaagctttatgctattaccacaagaaagttttgcctcttcaccacacagaatcctaatttagtttgggaaaaagaaacataacatccccattttccttacctgtaaaataaaaggtagtaagtagtttaagaaaactgtacttttcctaaagtttttaggactcttgtaaatagaataatagcagaatcatggaaacaaatttggaattgaagtcttgacctcattgaaagcccagaaatcaattagcttggtacttcccaatacatcagaaaagctctttctctttttgtgtcagtctctctgtgttagagggagaaacaaatacctgttcctttctacctcatttgttttggtgatcataaatgacccatgcccaagaagtgttccgagaatttcagaagccattcttgttttatttactttgttagtgaaagcatgtatttaagctttgttttggtcatgtgtgctaaggggagggtcctacctaaaggactggcttgttgagctgaggattaatcatgttatttgttgtttttcccctgtgaacagaagcccccaatgcatccaacttgaaaattgtaagaatggacaggacagctggatgtgtgactggaggggaggaaatttatcttctttgtgacaaagttcagaaaggtaaatacattctgtgatctctgatctcaagaggtgtgatcttgacacactacagttctgagtgtgtctgtgagtcacatttcagcagtggacaagaaacatccctctgctgccacagaaagtcttaaaaagcatttacgttttacctcttccaaatgtaaattgtctgtgttattttttcctaagtcaactaaatcacttttagatttcccatggaagtaaaaagaaataagaaaaccgtgataattataatcagtgactttcagtatctttatacattaaaattaatatctgtactttgttaaacaaaaataaataatagcccattcttgacacacatacaaacacacacacagaataatgttttacatagtattaaattgtttttatttcttttgcaatgctttgatataacactgagagaacttctctgaacacttccacagatgtgatgtttaagaaaaggaaagaaaacagggaatacagggaaattctcagagcacatttctctcacaattttccctttgaggaaaggttcttggcgtttatctttcattagatatattacaacattgatagattagtaaaagctgaggaaaatgtgttattttctcaaactgcattctttttttaaataaaatgatagttggaaagtgtagtataatatctatttactacagggtgagcattttcaaagtaagcagatacctaactgaaaatataaataagtaaaataaatcaataaaagacatgtggcttttaaaaaaattatcatatgagattaaattctctgaggtatatagtcagaaaaaaatgggatcagattttaaagtaaacacatatatactttatccaaaaaaatttacaggccaggcatggtaactcatgcctgtaatcccagcactttgggaggctgaggtgggaggattgcttgaacccaggagtttgaggctgtagtgagctattatcatgctgctgtactccagcctagatgacagagcgagaccctgtctcaaaaaaaagaagtttacactttctctgcctacactagtgtcagccttcttccaatccactctgtccaagtaatactcatttccagattcctgggtgtacatactgtgagtaaacacaatctgagtacctttatttgtaaatgagatccttagtcattatcattacattggaatggcttagtaagaaatgtcttgtacttggcttaaagaatctcaataactaggtccagtgtagtcctacctgaaggcaaaggagattgtaagatgttttatccattcctagtatttctaaaattctacttacatagagataaaaactttgaacaaagtcaatagtgtggccctttctatgaaacggaaagtgaagccaggaagatgccaacctaagttacattgtcacatttctgtagaagtgaatagagtatttataaacatgctgaacatggagtatttataaacacactccatgactagagtgtgcaatttaagcattgcattttaattagaagggacctgattattatagtattttgaccaattactcaatatgaactaagagactattatagtgagacagtttaatagtgtgttaagagcctggactctgaaattatactgtctatgttaaaatcctggttcctccaagtactagctgttcagccttggataagtacttaacctctttggaccccagtttctcttttgcaaagtgaggataataatagtacccatctacatcacaaggttgtggtgaggatgaaatcagttaatatgtgtatatatgaagcacttagaatagcatctgccatacattaatagtaaaacttatataagttaattatttttatgtacatctatatattgaattgcactgcctcgttggattctaatattcttccaccatcgttcgtgtttctcaggattggcttaaggatggagaagcagtaaggtcaaagattaaaagaaaattcaagttaactaggtaaatctagtattctgtcattgtgaatgaaagttggggcgcattactgtggtaaataatgaaaaaagtcagtgatttgtgaagattttaaaagactgaaccttttgatcttgttttttaaaagtgtaaatagatagtaggtagaatattaaaccagttttatttttcagcatgtttataaatactatttacactatgtgaaattacacacttcaatgtgattgtttgcagatgacatccagattcgattttatgaagaggaagaaaatggtggagtctgggaaggatttggagatttttcccccacagatgttcatagacaagtaagtgatttattattattattaatccttattatttttagagatgggatctcactctgacacccaggctgcagtgcagtggtacaatcacagctcactgtatcccccaactgttgggcttgagggatcctcctgtctcaacctaccaaatatctgggactacaggcatgctaccatgcccagctagtttcttcagttttattttttttgtagagatgatgtcttgccatcttgctcaggctcgtcttgaactcctggacttaagcgattatcccacattggcctcccaaaatgctgggattataggcatgatccatattactatcatcattttatactttctgccttattgaaatttagtacttagcttccatctataaaaaagaaaaatcataaatatttaacttccataaaacagtactatttttaagactcatgcaggtcatccaaaaaagttacctactgtagagttatgggcaaggttctgttagatcgtttgctctgagatgttggcaagatatttaattgctgcctaatcccctaacccataagacagtgccccacaggtcctttaatgaaaatgtttttaagtgttctaccaaagtaattatgatgagacctattttatgatagcacctaattatgataacaccttaaaagggtgttctaggagtcatcttctaattgaagctgatgtcatcctgttaaatgaagatttcccaatggcaactgattaaatgatcagtttaatcatttaataacatgataatgctgagcccccaccttaattattattctcctatttacaagtaattgaagagtattctcctatttacaagtaattatctggattggaaacaatccagatattcatcagtaagtggccagttaaattatggtctgtccttttgatgaaatatcatgtagttattcaaaagaatgagtactctgcgaactaatatagaaagatctcagttatacagtgttaaaatattttaaaagatgggtgtagaacaaagtgtgtgtagaaatgattctatgttcatgcataaagaaattctggaaggatacctaagaaattaataacagtatttaccactggctggtacactgtaggaactgcatggatggggaacaagaatgtcaaagagaataccactgtatgcttttttatattttataagatctttatccctgtgaatatattacatagtcaaaaaatcaaactgaaaaatgcttaaatccctaacataccaccaagaactaatgtgttatgatgccaatgtaagcaatgtttagtttcttctcttcatcactggcctgtagccatctctctctttccatacccagtctttctgatgttgctctaaataatcttggaggcttttaaggctgctttggaagagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgcaaaaaaaaaaaaaatgtagtcctacaccaacatgtggttcttcgtatcctgcagtttgccattgtcttcaaaactccaaagtataaagatattaatattacaaaaccagcctctgtgtttgtccagcttcggaggaaatctgacttggaaactagtgaaccaaaacctttcctctactatcctgaaatcaaaggtaagtcagttgtttaaaatcttatgctcatattttattttattttatttttggtttttgttttgttttgttttgttttgagacagagtctgactctgttgcccaggctggagtgcaatggtgcaatcatagctcactgcaacttcgaactcctggcctcaaacagttctcctgccccagcatctcaaatagctgggactacaggtgtgcgccaccatgccgggctaatttttttttttttttacttttaatagaaatgaggacttcctacattgtccaggctggccttaaactcctggccttaagcagtcctccggccttggcctcccaaagtgctgggattacaggcttgagctgccatgtcttgccattgtgcttgttctgagaagaggacaagctaattagaaaagatcagttagtcacctcctttgaacagctttctagtaacaggtccctggatccatggtgcttatttttagaagagacagtagtatattattttgaggtcatggaattagtctagctttttaaaataatgttatttccaccaagcttatatgagatttagacattgagaatttgtctttgaatttgagaatctaacatttattgactaactcagagttcaagcagctgagatgaaaaaatcaggcttgctgtttaggagaatcagccagttagtcaaccagcctcaggcggtggaacagaaaacttggccaacatgcactgtgaaactatgaaaatgagtaaggcatcattctttctctcacaaaagatgctttaagaaagggcactcataggtttcttaaatagttataatgtaaattatgattttaataagtaccgaaagtgaagcatccataaaaatataagagaatgttgaagagagagcccttggtccctttattctaaagcagcctccaaaaagaaggcttcgtcaaggagatatcatttggccctcagcatttggggtatatttcagcagttgggtgttaaacagagaaggagagggttctctaggtttaagttacttgaggagcttaaagagagaggtaaacacagcgtttatgcagagggaaaaaagtgttctgagcgctcggatggacatgaaggccaatgtgggtaaggaaggccagggccaggctaaagagggctgtgaatggcagcttaagaattttgcattaattctggagagggatagccgggcctgcctaggtttggaatgatggctctgacttctttatgtcaccactgagggtaccatttaggaggcagatgatgagtcagaagagtaatgcaagaatccaagtgagaaacagtgcagttagtaaaggtcctagtgccaggaatgaaaggagatggtggacttaagagagagtgcagtgatactgtgatacagtgatactgtcaagagggcctagaggtcggaggtgtaggagagacggggagtcatagatgggtctaagactccctgaccaggaagcttgtgatgtggttgacttgatgaaaggaacaagggagcaaaagtagatttgggtgggaaaagaaggagctcagagtaaaacatgttatattttaggtccctgtgggaaaatcaagtgtaagttcttagtaggcagatcaaaaggcagaactggaactcaagagaggacagggtgagaaatttagcattagaatcatctcaaaacgagatataacaggcaccaactgagtcatcattcaaaggtatttcttaacctagagtccactgacccccaaagagtctgtggatagaaatgtactttgatatcatcagcttcttttataatcctgttttgtattttacatactgaaaaccatgattctgagaagagatccatagagttcaccagactgcagaaggggctgtggcacaaacaaaattagaaacccctcagttggagggaagtgagactgggaagggaggtcagtaaaatgattgccacggggcacccagatccttgctgaggttggaaaccgcaaaggtgcagcagcaacaagccacatgggtgggtgttgtctcctgtgagagcaagatgtgataggtaatctttgaagagggctttcctttcctagaattcgtgctgccacaggagtgtttagaaaacggttctacaagttcttgtttcttttctgaggttgtggcctctccattgtttggtcagatttgtagtgcactctatatcctggtggtttgaaaacattgtcagcacaataacttttctttcttcacatgagatttcatacaaaatcccagtgtatggacatggtaggctttgattaaaataggggtgaagggccctgccagctcggccttccgagaggctgtcccacctctccttacttccctatcaggagctgctggaggtcttttgaatgcttctgcctacacaaaatgatgtgaaaatcactgctttaatttaaacacccttctttaaaagtagacacagaagaaaaatatggataatttttttagactttctgaggaaaaaaatagatttcttctccagaaatatgtcttcaaataatgccagtttttgctaacacagagaatcatgaagaaagaaaacccaggttacctgtatgtgtatgaacctagaaacattcaaagctcagcttggtatctaggctgcctgtctccctttcccagtggtatctatgcctcagaaaagtatgttatagtgggggtatattcaggtgattactttaatgcctcgttatcatagtaggaactatccaatgcagggattagagaatggggtcacctgaaagttcaaaattgcacctgtatgcttcatgcacctaccttccaggctgtcattgatgaaaagcttcatacaatacaaagtttaagaactgtctggagaaatacttacccattgagctctgaaggaaagaatggacaacatatatatatatgaggacaacaaattacttgattctatagaaaccttctggattataaaaactcaagataataggaccaaggagaaataatctgaccaggcaatataactggtcagaaaagtagtaggccatttagcattagagtaagtagatagaaatggatccaaactgtacaacccagggaaacattgcatacatttctcagaagtcattgaacacacttttccttacccccagtctctgtagtcattccctatctcattgcctaattttatgttcttcattatttttatcaatatgtaaacctgtcttatctatttatttatgggtctattgtcttcctaccaccccgagtacaaagaatcttctttaggtcatagactatctagaacagtataagttgcatagaaaatgctcattaaatatctgtggactgacttattgattgaccagccaagctgccatccatcctcatctataaggctagtaatatgttgggtatcatcaggtaagacattatacataaatataaagcatcatacagaaccagcccggagctttgcatcctctatggtcatcaacattgtacttcacaaaaaattattggagatggttgggtccaggggagacgatcgaaataatcaagagaaggatgattggcagaggaggaagatagttgaggaactgctgtacaaaagcaaaaaaaaataaaaaaaaaataaaagagaccataatgatttttcagtctgaaagatggagattagggataaataatctttaaattatgaaaggtatggccaagataaatgcagtcacctttactggtaaactaaaacctgaaaagtgagaatgaggtacttttaaggcacatgcacagaaataggtagcaaacactaggagattatccatatttgtgaattgaactattatctaaagtcatcaactgttatgtaaagtcattgattattaaagtcactggttattattatacaaagctattttggagtgttttcaaaagaatgacagcctaacataatgaaaacatcactgcactttgagactgatcttgactccattgtgacctcagataagtcacctaacccctcctagcttcagtttcctctcctgcaaaaggagaacttgtagtaagtggctgctttggttccttctaaaataggttgatgtttcatagtacatcccatggtgccattgtcaaaagcagaccgcaaggataaatgatcccttgaatatggagtgtgaaagtctccatattcaattctgtggagattcaaacagcaggttcttttataaagcttatgtggaatgttctgtatcagtttcttgtcattggaatcttactagctgtgttataattaatattttgcccttaaaattcccattttacagtgaaatacagccaataaatatctctctgctttaaaaggtaaaatgaatacatagaaaatactaactagtctctttgctggaatccatgtcaatagataacatttatttctgaagataaataagttgcctgcttccctcttgtgtttcatatgtctgcagtgaacagtaatgagtatagctgtaaattagttatgatataaccgatggggaaattataaatctgaatctaaaacatatttgataagtaagtcaaagtttctccacttaaaggtcatccccttctagtggaagcatatttttctcaaaatttggcaaccttggttttttttttttcctgggaagtctggagatgctcagcttttaaacaactattaaagtgtactttgttaccctgctttcccctgcttcatctttcaactgcagttagatgatcatgagataatcagtaaacagagaccttctatctagccctaagatgactgaaacaaccacagaattagaaataatcgaagttctttctgaacataagcatgacaaaactgacattgaagaatcagaaatagaataattgttaagggttcagcactaatcaaaaaaaagaatacctcattgactgtatttaatttgaaaaaacgaaataaaacctccttaactgctccagcccaaaaaaagagaagaaaggtatatgatagaaaaagaagagaaagaaaaggaaacagaaaggagaaacaagaacacagtaacaccacataggcagtaacggaactcaaaagggcattggggctggtgagaagcacagatagcgagaaacagaaagatgaaaacaaaacaaaaagaaaagcaatcagaagtctcagagggcatcactgtattgtagtcaaatagtggtcttagacttttagccccagtatctcatcagtcaccagaggttacagatcccttggttactgtttttctggcatccaccccatttttattatcctggtgaccactaaggaatgggcctccatcacttatgtccgcattgtctctgcctctcactttaactctttagtatgtcccacacacacgtaaaagatgaacttcctaaaataccatcccctacacattatttccctgttcaaaaacattcagcagctttcttgcctgtaagttcattctccgggtgctccgcagtgttgtcccaaacagttccatttctcaggaattccttatacagtcatagcttgtttctttatattttgcaaatactgtgatttttacaaattgaaggtttgtggcaatagtgtcaagaaagtctattggtgccatttttcccacagcatgtactcactttatgtctctgtgtcacattttggtaattctctcaatactcgaaacttttccatgattattatatccattatggtgatctgtgaacagtgatctttgatgttttgggggtaccacaagaagtgtccatgtaagatgacaaacttaatcgataaatgttctgtgtgttctgactgctctactgactggcaattcctccatctctctccctctcctcaggcttccctattccctatcacacaaccatatggaaattaggccaattaataaccttacagtggcctccaagtgttcaagtgaaaggaaaagtcacacctctcacttgaaatcaaaagccaaaaatgattaagcttagtgaggaaggcatgtcaaaagctgagataagcccaaagctaggcctcttgtgccagttagccaaggttttagtggtctgagtagaagattaaaccagccacaacattcccttttaccaaagcctaatccagagaaaggccttaactctcttcaattctatgatggcttagagaggtgaggaggctgcagaaaaaaagttggaagctagcagaggttggttcatgaggtttaaaaaagaagccatctcgataacgtaaaagtgcaaggtgaagcaacaaatgctaacagagaagctgcagcaagttatccaggagatctagttcagaaaattgatgaaggtggccacaccaaacagattttcagtgtacaagaaacaaccttccattggaagaagatgccatctaggactttcataactagagagaagatgtagaaatgcctggcttcaaagcttttaaaaacaggctgactctcaggaggttgaggtgggaggatcacttgaacacagaaggtcgaggctgcagtgagctataattgcaccactgcactccagcctgggcaacagagtgagaccctggctcaaaaaaaaaaaaaaaaaaggcagactttctcattaggagttaatgcagctggtgactttaaattgaagccagtgctcatttatcattctgaaaatcctagagctcttaagaattatgccaaatcttctctgcctttgctctgtaaatggaacaagaaaacctggatgacagcacatctgtctacagcatggtttactgaatatttttaaacccactgttgagacctactgctctgagaaaaaagaaaaaaaaaggattcctttcaaaatggtagtgctcattgacaatacacctagtcacccaagagctctgaaggagatcttttcatggctactaacagccattctgcagcccatggatcaaaaagtaattttgactttcagtcttattgtttaagaaatacattctgtaaggctgtagctgccgtagatagtgattactctgatgaatctgggcaaagtaaattgaaaaccctgtggaaaggatttaccattaaccacatttgtgattcatggaaggaggtcaaaatatctacattaataagaatttggaagaaattgattccagccctcgtgggtgacattgaggggttcaaggcttcagtgaaggaagtaacagcagatgtggtggaaatagcaagagaatgagagtgagaagtagagcctgaagatgagactgaactgctgctcatgatttaactttcatggttgaggaattgcttcttatggatgagcaaagaaagtagtttcttgagatagaatctactcctggagaagatgctgtgaacattcttgaaatgacaataatttagaatattccataaacttagtaaagcagcagcagtgtttgagagaattgaccctagtgtggaaagaagttaaaactgtggataaaatgttatcaaaacagcattgtatactatagagaaatcttttgtgaaaggaagagtgaattgacaaatttcatttttgtcttatttttaaaaattgccacaaccacccagccttcagtagccaccacccttatcagtcagcagccatcaacattgaggcaagaccttccaccagtacaaagattacaacctgctgtaggcttaggtgatcattagcctgttttagcaataaagtgtttttaattaagatatgtacattgctttttaagacattctgttgcacacttaatagcctatagtatagtgtaaacataatttttttgtgtactgggaaaccaaaaacatcatgtgacttggtttgttgcagtaatgtggaattgaacctttcaatatctcagaggcatgcctgtactaaactttcacttcagccaaacttatctactcctgttctcaaaagcaccctgtgtacatcttctttttcctcttcttatataaaactgattctgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggggttattttaatgtcttctacataggcaagtctgagtttggttggtgaccctcactattagcctctccccttcacataggagtgaaggctttctccattacaacccctccccaaatctggggtgctgtcagagttgccaacatgtaaactttaccaaagtggaattctgatagtcccatgacccccaccatgtgtcttagtcccaacagaaaaaccatgtgtgggcacaatactgtcctgtcacaccaaaggctgtgctcacctgagagacagacactaagttgtgctgagtctttgtaaaatatcttcatgatgtttcatttgttttacttgccgtttcagggtatagcttcccacactatggatttcctacttatggtgggattactttccatcctggaactactaaatctaatgctgggatgaagcatggtaagtaatgctttgttcttaataccaagaaaggaaaaaaataattaatgctaaaaagggtttttaaaatcattacttatcacaacagtattatcatcttgacaaataattgatgaatgcaaataaactaagaagatacttttcccaaaagatattatttcctgtggctagtataaactctattacttttatatattttatatatttactttgtaagtggcatgaacagaggaaagaaaagagcattgaaaagagacaacagagacctgactattcaaatattttaaacatcatcaaacttaatgtattctgtctctttttttctcaaatagtacacttctgaaatcattttgagttttataggatcggtcttttcccatcaagtcatcccctgagaagctgcagttaaaccacatgttgatagtttatattacaggtccattctagtgtacccatggaagaaataatactataaagaagtcttcccatttattgaatacctatttttgtgccaagtgcttttacatgttttaactgttatcttcatgactgctctatatggaaaatagtaactccattttgcacacaaaaggcatcaaagttcagaaatgttcgtactcactgaaggcacacagaagttagtggcagaacaagaatttgaagcaggtctcctgcagaaaagctagatgctctcatagtatctgtcagataacatagttgaacctgaaagagggtgatcaggaatggtacactggataactcccacactaaagaatgtgagtcgacaacacgtctttatgatttgctttgttcattagcattaggaaaaaactgctctgttttcaagaactttaaaaattcagctttcctgcaattcatagaagagctttatttcatttttctcctttacaaataagcaaaatgagatttaagattttagaagtatactaaaaatgatttttagaaatgagtttagaatatctccaaaacatggtatttatgatatgaccatttttaaaagaattttaaattattatttttcttttccttttgcagcaaacttgtctcttacctttatctgacctacattggaatagcgaattatcactaaatacattttactgagaaaaatctgatgtttttgcatttatcttaggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcagggtaagtgagcacacaaattacgttctgttggttggctggggaggggtcagtcctaggtgcagaaagatatctgctaatctaaagatgatatatcaatatctagtttagtgtactcttcaaagttctgtatgcctttggaaaagcatatgtcagatcattttattcacactgggatttccatttttgctctgttatctttgaatgtaaaggacagaaatttatatgtacattctccagtcataatcatgcagttttagggtattgtgagagataatcaacttcttttctggcacagataaatagagaagtatttccacaagcttaatagtcaccctgtctagattctggcttaaccgtcatactgaaatagaactttgccttaaaataggaacttttctttttatcttgtgccctctttgaagaagtaggattaggagaaaatgtacttttgcgtttactgtgaaccaatacttattagcatatgtgtcatgattctaggtcatcctagatcgtactaagaagacgtctataaaagcaaaggtagtaaatatttagagttggtggccacatgtggtgtctatcacatatgctttttttttacacccctttaaaaatgtataagccatgattagctagggagctatatgaaaagcaggccataaacaggttttggcccaaaggtcacaaatgccattccctgaccttaatggaacaaactttacaaaaacgtgagtggctcattgaacgtctctgtttatggcagagatgtgtgttttttcacacattgcctaacaagctaattgttagagattccaatgaaggattatttcaccaagatattggtgatttaaaatcatggtaaaatctaacattgtttggagattgttttccttaaaataacagataatggtcgttcccttaaaataatacatttctaaacttttttcctctaacaaatcatacacagattctttaagatcaatctctaactatatttgtcagtgacccagtgtccaattctgctttttctagtccacacaatccaaaagcattgaaagaacattttcaactaaaatgatatgtcaaggtgtcagaacactgatgctggtcagtttgtccttaagcatgccatacccataaaacaaaagtaggaacactcaactatgattgtggtcattgccttacagataacctctttctagagaaggctatgcagcttgcaaagaggcatgccaatgcccttttcgactacgcggtgacaggagacgtgaagatgctgctggccgtccagcgccatctcactgctgtgcaggatgagaatggggacaggtaagtcagaacttttgcatgataggttgtcctgggtggggaagaagaagagcatcgtataatgcatactgactagagataaaaataattgttcaaatatattgagtcctctaactggaatgatgaagaaaaataatgtgtgaataaggttaagtagcacaatttgctgctccatcctgctgctgtcatctgttggaatctgtagtagctggaggactcatctaagagtgaatctctctgggcaagaaaactaagatgtgtgtaggtaatggtactttttgaaaagccttgctttgtttattgaagtaatatttggagaattgttaagagtcctaccaaatccctgaagcattgttatcccagctgcatatttatgacagtgtactcaagaaaaagcccaataaaggcagcaacaacaacagaaagattaagagggactggtcattatttcccagttactggtttcttctctgctccctcttctgatggtcatcagtctatgactgtttcagacttttgtgactgctccagcccatatgtgggagtggaacattccaaacaccatgccttccattcttgctattactgagattgtatttgcaaagccacctggcttctttctaaaacagttctcttagtcctttcattgagacttctaaaatgatctcaaaagcctataaaaataacaagagacagcagccttcacattcaagtcaagtgccttatctaaaaccttcctaaaatagcatcaacatagagaaatccttttctgtggaagagctcttgagtgctgtgttttagacttcagtttaaaaattaaaccaagcactttaggaaagtaacaacctcagggtttcaagcagagacacctttgttctcattccttgcaacgtaaccaaggatgtggtataaccactggccttgttatacagtatgagaggaaccagtacaaccttcttggtataaagccatgaacagcagaattctttttcagggttaaataatccagttagcattcagtagcatacaaccacaagaaaaagcagttaaccaagacagtacagcagtgtttcaagtggcatttccagggacctgttaaattgataagtctaagaagatgagcacatacaggttagaaaggaagtgctgatatctgaagggaggattgttggaagggatacaaggcgaggcacatgcaagttccctcctaagacccaagcacactcacacaagccggctctcagagaggccacagatttgggacttggagagaccagaggatcctcataagagcataggtatagggcagcttttggccatcacagcccaagtctcttgttttaattcagctcgtcatatttggctaatagtttaaatcctgtggccattagtcatcatagaaaatataataaagaaaaatatataaaacttctgctattggggaaattcccataagggtgtgaggatttgagggggagggggaatgtacttctgctatgaaatgctgagcggcacatggaaattttcgagcagttttagaagtatgacctttttcttggtgtatgtgcatcatgtctatgtcagagtttaggcccttttcagaagtcttcttccagtatcacatttcaagaagcaatagtgaaaccctgagatcatccgttttaaaatatttctcaagtagcaaaatcacaatttagttttttaggctcttctgtgccggagttaatcccaagtacgatatacttgctattgctaaggaagaggcttgagtaaagtggcacctgatagcttattttagagaagatccagcctgtacctcgtgtcccagatgtagtgctgctgcgagatgctttagtgtgctctgcacctcaatctgtccatgctctggagtggtcatcttcttagacattcatctgaatgtctttagaacagtgcacatgtatcccctatgcaggattgcttaagggattaagagatggctttggagtaagacaggcctgggcttgaatcccagcttcaccacgtattggccttgactgagttatatgacgcctgcaagtctcagtttcattagctgaaaagtgaagataatattacctaactcataggattattgttatagtaaaaagacaatatatatcaaatgcttagcatagtctggtaaatcaaagctcccaacaaatagtagccactggtaaaatgattgttattgttattgttttgaattttaatagtatgttttttaataattaaaagaattacgctcctgtgagtgactttgacaccaccagtatgttcagcctcattagcgtaagctcttaagttccttctatcattcttatttttgtgcctctactgcatgctagggttgtaaggctgactcagacagaacctgccccagagatgacaggacagagaacgagaaaaatgtgtagaaaactgcagttgcataaccaagcagtaaatttgagagggacaacttgctccacctaggaggttaggaaagtattctctgaggatgtcaggtttgaactggaatataaaggatggagtaggcattgttcaggcagaagaaaggagcaaaaacattccaggcagagggaatatttgctggaatgtttgcaggagtggtgggaaatacaatcactttgtttcttcacaagtttactgcaagaattttcttccagtagttaaaagcttcactccattctccactcttgggatctggaaagatctttaaaaaaccaccacactgtattttggaggagggcagcagggctaagtgaggtaactaagtttttctgaacaattcctagtgccaggcattcattttacatagaatctgtgtgtcaggaaaagtcagggggaaaggtagagaagaaaaccgcccaaagccatggtatagaggcaggattgggatttaagcttaggtctttctgggctggaagcctcagtgtgtttatacatcaaggggtcaagacctgaatgctcccagaggccaggaaggtaccacaaataacgtagcagccttgggtaggcagttgggagggaccagtcctctggagacagcatcccacctcagattcaatgcattttatagattcaaaacattttagggccaaataaaactaggtatgagagcagattccattcttgagtctaatcacatcttgggaatcttttctttttcattaacattttagttaattattgccactgtgttttcattccagtgtcttacacttagcaatcatccaccttcattctcaacttgtgagggatctactagaagtcacatctggtttgatttctgatgacattatcaacatgagaaatgatctgtaccaggtaagcagaaatctcaagaaaacaactgaagaaaaatctgtagtttactttttcttctgttatgtttgggtgcatgttatttttagtaatgttaacagtagcaaaaacaaaaacaaacctttgtaggtaatatctaaaatcccattagttgagaatgttactttatgatgtaggatcctttgatctgtgggtataacagccatcaagccacaatgaaattcagcatcccgctgggggaaggcaaactttaaactttagaaatcaaacagttttttcatttaagagggagaaactaaagtaaaaatgtcacatctgtcaagaaaaataaagttaaaaaaagtttgaaaagccagtaatttataataattttgaagtctactgaaacataccttgacaacatccagattaaatgtatatcaaatgaagcattctgaaatcaccacacagaaaggttaaaagtttgcttgaggaggaaaaggtgtctttcaaaagcagaaagacagctccaagtgaggaaaagtgggaacaccagagttttgcccaaatcaggttttcttaggaattaattaggtgggctgaaaatacaagttgaggaactgttttttccagaggtcttccaacactgcaaagggagagttagctggagacacagcgaggccctttgatgggcatatgcagaattcagggagaggcaaggagcctgggagccacttcggcagaagcagagcttggacgttggtgatgggagcccagtgaccccagccagcctttctggctgagcgactgcactggcatgaaaccaagatggggttcggctcctgaggtttcctccttcctgcccctgattgcttttcccacctcactgtctttcccctactcccaccagtctgctgtatggggctcctgcccttgcccacttcttacctttccatttgtctccttcccttcatcgacccgaagcatcttcctcatcctccttggagagatggtttgctggttcacgtgtatctctcactccaaaactatggccaaaatcctgtgtaattatttacttagtaaagatatttgttcctgctctctcagtttttatagcagtgatgtgaatcatttctatttcctcactttaaaggaaaatgcttttattattttaaagaaaattaattaaaacttcattttctttaaaggaaattaaaatatctattttcttatttttatttccattctttaaaatgtgctttaggctgggtgcggtggctcacacctataatcccagcactttgggaggccgaggcaggcggatcatgagatcaggagatcgagatcatcctggctaacatggtgaaaccccgtctctactagaaatacaaaaaaaaaaaaaaaattagccaggcatggtggcaggcgcctgtagtcccagctactcgggaggctgaggcaggagaatggtgtgaacctggaggctgagcttgcaatgaggcgagatcgcgccactgcactccagcctgggtgacagagtgacgctctgtctcaaaaaaaaaaaaaaaagtgtgctttaaagtgcatttaaagcaaaactactaaaacgtttacatgtggctcttaatagtttttacctgtgactaggtaaaaattaataggtttcctgataggggaaaatgaccatttttcattcaatataagtcaccattaggcttcttcactggctcttgtgcttcttgtcaaaggaaaagtaaagttagtgactcttcactgcctgttaatataaaataactagtatgaagtgtgattgtagatttacatttaaaggatgtcttcttgaaactttcataccgttttggggtcattggtatccgtaaggtcattttgcctgtaaagcttgattctcgcagacttttggctgattgttccttgtagtcatcacaaatctatgaataaaaccaggaatgggacattgtagcttgtcagtcctcttttcaaaccctgcttaacagtcatattcaaggaattacttattttatgtttataaataggatctgcaaaggacacagcacaacaggattagtagctgtgatttttttttggagacagagtctcactctgtcacccagactggaatgcagtggcgcgatctcggctcactgcaacctccacctcccaggttcaagcgattcttctgcctcagcctcctgagtagctgggattacaggcgtgcaccaccacacccagctaatttttgtatttttagtagagatggggtttcaccatgttggtctggctggtcttgaactcctgatctcgtaatctgccagcctcggcctcccaaagtgctgggattacaggcatgagccactgcgtctggccagtagctatgattttttttttatatcctaaactctttactgtatcatttggttacatatgttgagactctccagtgtgttagagacaaaaaccctgaaaccgccaccattgatacttctatcccttctgatttggggactctcagaagactatacgtccatttttcccctaccttaccaccagtctgattaatgggcagtgattctggcttccctagtatgccttctaggtgtcaaacacacacccaatggcaactttgatttgagaattagaaactgctaagatttgaactcttgattatctgttgtaaaggttctctagtaactattcttaatggaaaatgatacagttctctaaataatttggattatttgacagttaagcattcttcccaaatacctttcactaatctaagtacatttctgtgaccatctgtcatgatcaaattcctctccccacccaccctctagaaacacactcaaaatagtccaagtgcaccgagttaggattttttatgaaaatattctctttaagcctttttctcctttcattctccttcccccaacatagacaaccactctatcgtgtttggtatggattgttttatttgtgtatgttcccataaaacattattggagggttttatgtatttttatgtttttaattattatacatatcatgtatattcatagttttaaaaatggtacagaagaatctacattggaaagtcaaagttgcccaccctgacaatgcccaggtctgctagcacaaatgtcactattgtgtttataggtagtttttcaagtactggatacaaatgtacgtatacttgaaatacatagatattttcatatactctcacatacaatccacattatattaaatgtacttctcttgccttgcattaacctttaaaatttttttaatttaatttaattatagattcaaaggaggttacaaaaacgtactaggaagtcctagtatttactgcaaggaaaccagaggtctcttcacccagtttcccccaatggtaacatcctgcataacctcagaacagtgtcaaaacctggaaatagacgttgatacaatccacagatcttaatcagatttcaccagttttacacacacttgtgtgtatctgtatagttctttgtgcatatattttttaaatgcctaagtggcattgtgctacatgttactgtatttctgccttcactgcttatccacacagttctacatatagctagtttgttgtttcagctcctgaagagaatctagtatgggtctttcacctataacatccttgtttcctagtagtagacatttaaccaacttctaacttcctacctcagtagataatactgcagtgactgtcctcacttatgtcctcttgtggatttgtgtcagaatttcacccagatacatctgcaagagttgggttgctgggacatttgtatatttggctttccagaatgtctgtgtaagtccccatgcccacagccatagcatgaaggtataattgtttaagatataatccttggatttaagaactagaaggtttatatcatggaaaaccattgattggactgtggaagaaaatattaaaaaaaaaaaacctctccgactcataagatattttttaattaaattcaagctacagataatttataattcctgaatggtatactatcttataatttcagatccttttttcacaatctcattctctttccttttcccatctccccaagtagcatttcagaaaacacagattagtaaacacagtttccattgacttatttttgagaagaaggctcttggcaacaatatctaaagttttgaggacatcacttcatttcaggccaggttgatagtcctagaaaatgaaagaaataagggcaagtaataatttggcaaaaaaaaagggtcttgtatagtaaataatcactgtagttgagatttagactaccctcccatcattcatcctgccagttatcatgtgctgtggtcacctacacagctaggaggttggtggctcacctgctgctgtagccagtaactgctcaatgaaaagggaattttaggcaaattgtcacaagactggctggatgtcatagttaggctcctgtgaaataaactgatttgtataaagatacattgctgttctctgtcagtgaactcagttatttgaaagatacgtttgtgattgtatttgtcttactcatttttgaaaacacacagtttgcaaaacatcttatttgcattcaccgaagtaataccttgtgggcaggatagtcaaatggactatttaagtacctattaggtatcagcagctcaccttttttattcagctgagcccccttggtgagatacttgtattatcctggttatgttatttagaatcttataataccttttatgaaatgggtgtaggaaagctatattgactggtctcaggagccagtccatgggacagtattttttaatttagtaaatttagtttccatgtcagcatagaatcatggcacttttgttaattggtttctattgagtactttatttaaatttcttcagtgaaaacatagccttaatttgatttgttaatataaaattatcagctggaggtaactcctaccagatatttaagaaaactaaatttactactaggtgtgctcaaaatcaacaatcagtgggttgtagtgagaaacaagaagctattaagacttgtaaatatgaaaataacccaccacagaaaaaattgtaagtatatgaagtgatggatttgtaacttagcctgatttaatcattttatgttgtaaacttagattaaaacatcacattgtacctcataaatatatacaattactatttgtcaattaaatttaagataaataagaattttaaaacatgaattattgaatggctaagtgttagtacagtatatgtacttcattagcatatagtatggaacaggataacttgggtgccaaggtcagaagttaatctgggaatgagaaatattcctgcagtatggccccacctattgcagtaacagctaccaagctgtgagttgtaagtaagtattcactgctgaccagtgaatctcctgccctttcactttccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgatgcccatgtggacagtactacctacgatggaaccacacccctgcatatagcagctgggagagggtccaccaggctggcagctcttctcaaagcagcaggtaagatggtgatctggcggtcattaatgaaaaatgttaccaggaatgcaaacccaacttcaatagagcagtcatgttgccttctttaagccacagacctactgctgaaaaacaagggtaaataaaaattatatggcaaatcacattttatctgccataaggcactgtttggactagtaatcttgggctttaccctgatagtcattttagtttttactttctgattcatctgtttgtttggggtttgattgtttagattgactcccatgacaaagggtcttttcaaagtagagtttgattccttatagaattctgagtggtattagtctcagatcatatcagaaggccccagaagaaaaagattattggtataagaaatcatttaaagacttcattttgaaagaaatatctcttagaaattgaagtgtaggaaaaagaaaatgggccatgtattaagacccattatgtggaaggcactaaaaatggctagcacttattgacctttctgtgtaccaggcactgtgatatgcactttatgtgcacagtctcatttaatgcccaatcaccccttgtgacaaataccattattccccatcttagagtcaaggaaacagactagagagactaccagatcccacttcagggttccagtaagtgacagagctatgaatcacacttcggcagtgtgaacttcaagactttattctctgtactatgtttctctctcctattttgctcataggtttgcagatgttattccatttaattctctagtcctgtgaagtatagaaaattatccatgctgatctttgaatctccagtgccttgcatatttagaacctcaaaatatgtgtaatgaaattggcatctgaagcctgccctgacatatctgatatactttagaggctttttttttttttaacttaaaaggtaaatgcttcataaattcaagaaaacaaagcaaaagacataggaactttttctttgggacaccatatttttcttttctcttttgttaaatagaactttttcttgaacaagaaactctgattgcagtgggtattaatagttttagaagacactgattaattaaatgccttccaacaagaagctataaccagccagacgtgatggctcacacctgtaaactcagcactttgagaggctgaggtgggagggtcacttgcactaggagtgtgagaccaaccaggttaacattgtaagacctcatctccattaaaaaatttaaaaagtagccaggcatggtggcatgcgcctatagtcgcagctagtttggaggccgaggtagaagtatcacttgagcctgtgagttcaagggtgcagtgagctacagtttcaccactgcactccagcctgagctatagaataagaataagaccctgtctcaaaaaaaaaaaagaaaaagaaagaaactataacccttttaaaaatgctttatattgaattctcagaatcccatgaaaggaaaagcaagtaacagtttctctgatatataaatgaagaaactcagatgaaaaaccaagtcctaatcttaatgtcgtggaaaaggtcagttaagtccgagtgtggtggctcacacctgtaatcccagcactttgggaggccagggtgggtggatcacctgagactggcagttcgagactcacctggccaacatgacgaaaccccatctctactaaaaatacaaaacttagctgggcgtggtggcatgcatctgtaatcccagctactcagaaggctaaggaaggagaataacttgagccctggaggctgaggttgcagtgagctgagactgcgccattgcactccagcctgggcaacagagcaagactccatctcaaaaaaaaaaaaaaaaaaaaaaagcgtcagttaagagatagctcatccctccacactttggtcctgtaaattgttcatcttaatttctccatggattacatttattgcctcatagatcaggccagaactgggagaataaaatcaagaaacagcatgaagatccttctttgtttcccattaagtactcctctattattgatattgacccatctgatgttctcccagcaagataaaaacaagttcctccctcaaaaatggcatcattagacatcaagctaaacactcataaaaatcatctaagcctctgagaagtaactctagctctagtctttgagttactttgatgttttgtttatttgtttgttgtttttgtttttgctggatgctaaagagcagactacatttcccaaaatatttcaataattatacatcctagtaggtttgtttatttaaagatcagaaccctggcattgctgtacccagcaatgaaactggccatgctgtcactagacatcaagcatctttgctcttttgagtgtccaagaaaaggggctgagaaatacacattgtcatgcataaatttgaacagttaggaccctaatcctgagggtgcaccctagtggctgtaatcatgctgtccatcagccctaagattaaagatgcactattcagttgagaaatatcctgtagagttaaatgtgaaagagtatttgaagtctttttttcttcaatagtatctttggctatttcaggtgtcataagacactttaacaatcaaagtaaattacaattttaaaataatttctctggatattccagtagaaatgttttatgatttaaaaattatccaggagattgcctcaagctgctacattgctttgcctttgggaatctgacctttgcaggcagttggaagttgacaagatctgggtttacctaatgctgtgtaatctaacttcgcaggagcagatcccctggtggagaactttgagcctctctatgacctggatgactcttgggaaaatgcaggagaggatgaaggagttgtgcctggaaccacgcctctagatatggccaccagctggcaggtgagtgccgctccatctgtctgatggctgcccctgagggagtcagaggttcaggaatgtaagaacagatggtcttcctggtgctttattccccaaagaacatgccttttatttttaagaaagtctgtttgtcagagaccatttttatcttgaaaaaccctatccatgaaagatctaggtcagctgagttctgagtacgaaagtgtatgcctaatcagatcagagttgagatgtgagaaaaggttagaagaaaaacacaaaattcacataaaagttacccattccaaattcacaccataattgtgaccatctcaatttctgaagctaggataaatgttactgtttgcttaggacttaggtaagtgatttcaggatgtaaaaataaactaagaattcttcttagaatttcaataaatataaacagagtaaatagatttaaagccttcctcaaaactccacagggctgagatctgaaggtataaagcagttactaggtcatttggccccaggaagaaaagccagagggaggaggtgggcagcatgcaagatctccaacatgacaagatcagttcttctagagacgagagctgctccacttctaaaactgctcatgtgcctcccacagcctgtatgtgtccagctcactgacgttagcagagactccatggttctccctttatgttagcacctcatttccccagaaggccttgccacagaacacaaaaagatgatgcactcagtgaccccacgctctccttacccaggtcagccagcaacagagtgactgcagagaacaccacaaatgcctcggcagctacagaataatttttcttttagcctaagacaattctggaccctcagttaaaatgtcagtattgccagagggttaacaccaagccttgtgaacatctagacatctcaatttgagcaagtttatacaattcattctcataagcttgttcctatggaagaagggagacagcttcacagctctgagtaagctcttcactagccttaggtctctgagcaggagatgattgacatggtggcctggactgcctgttccttccaaaaggctatagctctgactctctgcagtttggttgggtattctgacccagctcagagtttgtgcaaagcactatttcccagtaccagagcccctacagctgttcttcccccaaagggtaccatattcttggagggtggtcctgattcctcttgccattcctccatcattaggtaccaggccctcctaaggaggacatgctgagttgtttattataaagaaacagactgccctagtggtcccttcgatgtataacgatttctggtgtttttctttccaacaggtatttgacatattaaatgggaaaccatatgagccagagtttacatctgatgatttactagcacaaggtgggttgtgataaaaccagattctcttaaccattattatctccacactgtcatttaaagggaggaaccagcattatccagggtctactgttaaaagttcttatttcagaaccaaaagatgctggaggtagataaggagaatatccagttttaatctactgtaaatgtatactgccttctactcagctgggctttgaccttcaagtagagtagcttggttggttccactgggagttggacagcaagccaggcagcaatgatcagtccctccagagtgtctatggcatgttagaacaagtgtgttccttcttcatttccttcaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtaacaccttaccttacagatttagcaattttcatttgactttactctgttaacatctctggccagggcataatctccttcccttttccttaactctgaagaagaaaaccagtcattgcccaaggcctgggagggtgacccaggccaagttggcagcccatcttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatggggtgaagttttctgttgaaaatttcatggttagcttttgtttctgcatggatttcagagcttcagcttacagagggagactgtgtagacgtcactgtaggcagagtttcactgcctcagcgcttctctcgctgtctctctctctgcttactacaaaccacttctctgtgatttcctgagtggtctttgagccgaaacaggaaacttgattcgaagactgtattttcttagtcgctcttctctgccctttccatttcctcctggctcctgagtggaggaggcagcatggaagagggaagggtgggctgtcagtgcttacagcctgcactgggactcgaacacaagaacatgctcctccttcctttctttctcacaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaataaatactaaaaacaacatgatgtgggtgattaaatttaacacatgagagaaataatatttaccttaaagagagaaccatctccttcttcctttgcctcctctctcaagcttatgacactgaccttgtcccccaccatatatgggactacgtgtcatgccaccaaaagtctcgcaaccatatgaaatggactctcaacccagcccagtaatcctatatttcctacaattttattctcccactctgtaaatgatgattccatgctttctatttctaaacccccaacactccttccctccccttactcatgcaacacccttgcttcacactctgttgaaaacagaagaaaccagaaccctctcacctttgcaccaagtgccagcccacctgtgcctgtgcccacattggcagccttccatccggacttggtgggttaaatttctttgcccagctgaggagccacctctcccctgagtctaaccccctcacctttactaggttgttgttcctgttaattcttacctctctctcctgtactagccgttcctcctccccactctccgactaggtcacctagcaagcatttcatgatttcctcatctttaaaaacaaaacacaccgaaacaatcaccctcttgatcccacatcccatttagctacagtccaattgctctattcccatacatagcagagctccttcaaagaattttttagagttattctttccagcttgccaccttccaccctctgcttggcctcctgcagttgggatcgcatccccaccgctccaccaggcctgctgtcctcacagtgaccggtcacctccacattgccagatctggtcacctccttttcaccttgaccacttgcagagtgtgtcatggttgacgcctaccttcaacttcagaccgtctccattcctggctcctccacagcacactcccctggctggctcttctacactcaccttttaaagtcacagccctccagggtcagtcctaaaccctccctgcttggtacctcacccaagcccaatactggctacatctgtcagaagcgctgccatcttccaggagattaagacaaaacccaagaattcctcaggagtcctttctgccactaatcacttcgtatgcgacgcatcgagtgtcatcctgtctgcaaccaccgccccaggccagcctgccgtcatttcctgcccaaattcttgcacggctcctactcagtccccttgtttccttcctgtccacctcccttcagtccattctctgcccaacagatggtatgattcttctaaaaaatcagtgacattgtattaattctgggttatgcccttcagttcattcagtcattcattcagcaaatcctgatccagcatacactgtgtgcctagcagtgttcgaggttttaaagataaaactgtgtccctgctttactcgtttgctttcttaaacattgctgtggaagctcttcctccacactgcgcctccattcccaagtgttttctctgctcccctggctcactagtctgaccaaccttttgactgtttcttcccattccctggaaagctcttaattggctggctctttcttgccactcagtttcagcacccatctcaccctgccagggggccttcccaggggagcaagggcagacgtcattgtccgcacttgagaaaggaataatgtatccgccggaaaacaacccagatctcctgagtcacagcccagtgctccttctgcacagatattaaaaaagaaaaaaagcaaatacttaacatttttttaaaaagtaaatacctaagcattaagcccttaatttgtagttatttttaggatatcgcatagtttgtaacccataatagacaccaaataaagattggttgattaaacaaatcagtcaataccaaaatgatagtcgtgccactggcattaaagtcttaatattctaatattggaatttggtacataagaagatagcattttgattagtgtatgttagacttctgtttccttcctcactgtataggaaataatttgtcttggtcatatccctaaggacacttataaacaaagggaattcaacctgattttccagtatagactcattttcaccaaaatcattttacttttattgctaccaaaaatgttttcaaggcaatgtatgctgtaatagcatatgaggcccagagagagatctcatttttagttcttgcttctgtcaccaatttattttgctgaggttcagcagtttccccagctatgaaatagataatacagtggttggaaaactacacttgatttctaagggaaaaaaaggtccactgtgagtcaagagaattcagaaaggattctcataaacacaagactagattgcaggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctca

SEQ ID NO: 1886 - DNA, 115990 bp, Homo sapiens; identical to SEQ ID NO: 1885

SEQ ID NO: 1887 - DNA, 7950 bp, Homo sapiens
gcaaccagagccgccgccacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgtacgtacacctgtacctgtgctggcgcacacacggcagcgtccgtgcagtcgcactcgcacacacatgcacacggagacgtgcccaccggtgcactggtgcctgcacccacacccttcacgcacaaactcaagatacgctcacccgtgtccgtacatcaagacaggcgctgacacacacccacactgagaagctcgggattcacctatctacacacatgctcgcttgcacactcatgttgacgccatggacacacaacatgcaaccaagcactacagccgaaacacacttgtggagctgtgatggagacacactcttgtattaggtgggggggggggggggggagcgtgcagagatctccctgtcgcctgcgcgcccagaaccggtgcggtgtgggaccagctgctgttgtgaggtttgggagagagagaaaagagcccactccgaggaggagacacttttcccgcagccccagaatcgcgttctcggggcagaaccccggggcctcccacaggaaagagcccccgcctacaggctgttcgaaggggaggccgtccgacagcaggaatgtccccccaaaagcccccggggtttatcagccgtggcctccctcctggcagaaaatcccaaggttgctccagaccgggggaggggagcgggaggcggacttggccccagactgccagcctcctcccggccgtgaaagaccctcctgttccctgccctggagggaggagggggcttaacccccaccggggcttcccggattctcctagacctctgcccgctgaaaagcagcgggagcccgtagactgtcgagggcctcccgcccctcccgtcgcgagggcggggccagtggcgtcatttccaggcccgccccctccggccccgcctccccttggtattttcgggactttcctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctgcccctcgtgtctgtccacctgtctgcccgagccccctctgctgccttacacctgtatgctcgcagatgctctcagcctgccagtctgtccatctgtctgcaactctgcctccaaaaggagctttctcttgggtctgaggaggaggggggagtgaccactgaagacttggagatgggaggtggggctgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtcctaaagcgggggagggagagcatgtgccctctctctgggggaggggctgggagatcgtggctcagcaaggtctctctgtccccagctgatggcccctacctggtgatcgtggaacagcctaagcaggtgagtgagcaaaagggagggtgtggaatggcttcagctttggggacaaatggggtagtggtagctggctggccatggaggagccattgccgaaggaggccacaggggattggatggtcactgctgctgatcagagtgctgtagtttggttcagggctactaccaggcactgcggtcactgctggcctgggtggtcttccctgatcacaatgctactatgcccttggaccttcagagaggcttccgatttcgatatggctgtgaaggcccctcccatggaggactgcccggtgcctccagtgagaagggccgaaagacctatcccactgtcaaggtgagccaggatggtgctggagggtgggctaagtggacagcatgcccaaggccctgactgacagtccctgcctctcctagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccagtaggtgccctctacgcctggcccccactggtatgcccgtctgccagtcccaggccccagcccacctccatgagcttagcatctgaccaaggggaaagatgtaggttggccccaaacccaagggcctaagtagaaactccaatggcttccttgaggaagtaaggctgagctgagccctggcaatgggaaaggtgcctcaggaagaaagaactgcatggccaaaggcctccgattctctcttctcagatttaacaacctgggtgtcctgcatgtgactaagaagaacatgatggggactatgatacaaaaacttcagaggcagcggctccgctctaggccccagggccttacgggtatgggtgcagggggtgggtcgggtatgggtgcagggggtgggtgggtcatgggaggtgctcatggaaggagcagggagggagaagcccaggggtcacacatgtacctactgcccagaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcagtgagtatcctgattgcctggggtgccaggcctggtggcagaggtggcatgaggggtgacctcaagctgtgcagtcaaacagacccaggtttcagaacctggccctgccacatatgagctgagtgatcctgagcaagtcatttcccccccgaagcttctgtctttagtaaatgtgtatattgggtgtttcctgcagctccaggggttgctgagataaggaatacaaagcccccagcttcttaaatgtggccttggctattgcatcatctcaactaatccatatcccactccatagaatctccgggggcatcaaacctgaagatttctcgaatggacaagacagcaggctctgtgcggggtggagatgaagtttatctgctttgtgacaaggtgcagaaaggtgagactggagcccactttgggcaccaaggacatcgagtataagactggggccagggaagctctagggtaaatggccccagagattccaccgggagctgtggccaagcttccgttttccttgtagatgacattgaggttcggttctatgaggatgatgagaatggatggcaggcctttggggacttctctcccacagatgtgcataaacaggtacccagggctagggcccgggcccgggctgggggctaaattaggctaaggactcactgacaccctgtgtctccctgcaccccccagtatgccattgtgttccggacacccccctatcacaagatgaagattgagcggcctgtaacagtgtttctgcaactgaaacgcaagcgaggaggggacgtgtctgattccaaacagttcacctattaccctctggtggaaggtggagctgggctgaggacctcagggtgctggcggggggccaggctgggctagaagaaggtcccaagagctagatgtggggatgcatgagccaagtcagaagtgcgagggtcccaggaggtgcttcctaggagccggccctgagggctcttctgggaagggcccctgaggcatgacacaataactgggctcaatctcattttcctctgcccccagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggtggctcacgcctgtaatccagccctttgggaggccaaggcaggcagattacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaaaaaaaaaaaaaatctgggagagtcatggctggtgcccgcttcccacagccctgcctgtatccacaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgaggtatggactccggggcacgggcggtcggggcgccggggctgaggacctagccctgacccacgccctctgtggcccgtagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacgtaggcaacagagggcctggcggacgaggcgcggggtgggggcaggaaagggaccggcacggaggcgggctctgcagttttcggacacgccaggcttcaagtccggcctcggtgttcacaagctctgttcaagctgcttggtctctccaaacttcagtttggtcgaccgtgcaaggggtacagtcatagcacttacctacctcaaaaggtgctgcgaaacgttaagtgcaggcacagcgatgccctgggccacgtgctgggttccatgggccccagcgagggagactatgagggcggtggggccttgaaagcgaaggatgctctgagtggctgggccagactctcgctccccaacccccagaccactgcacctagccatcatccacgggcagaccagtgtcattgagcagatagtctatgtcatccaccacgcccaggacctcggcgttgtcaacctcaccaaccacctgcaccaggtgcgggggcgcctactggggaggtgggaggggttggaaggcaagtgggtctcgggcctggctcaccctgctttcatccccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggtgagctccccatctcacctgactaagggggcaggcggggaccagggagggtatctggccagtgcccagaatggactatgaggtgtcgagattgaatggtcagggctggtccaggggctgccttaagggtcacagctgcaggttgagcatcctgcatccttaggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaaggtgggactgaggattgtggaaggagtggggccaagggtggtggaggggccaaagatggtgaaggggggggctggccaaggggaccatgctgtggtgtcaactctcgctgctcgcacccccagctccgggccaacgtgaacgctcgcacctttgcgggaaacacacccctgcacctggcagctggactggggtacccgaccctcacccgcctccttctgaaggctggtcagtctcaccctcaggggcacttgaacagggtggggggaagggagagaggtgcctcccagtcccccgactttgcagtccttaatgtaggcccccaccataccgccccatgacggcctccctctcccaggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaggccagcccgggactagaagtgctctgagtgacggggtccagagtatctggacttaaagacacaggcttaaggacgaggtgggaggtagtcagaactgcggctgtctccccaggtgaagaccttgctgctaaatgctgctcagaacaccatggagccacccctgaccccgcccagcccagcaggtgagaagcatcaggcatccccagcccgactcctctgactcctcacagaggtctcttctccttcaggacctctgaaggaggcctccctttctctaccctcagccccgtccatcacccctcatggtcctgtctgtcgcttaccttgggagaaaggcagtgttcaggtgtccatgtccccacccaactctggaggtaaatgacatgtctgtatgtgtgtccccctaagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgaggtgggttggcctgtgccctgccccctccccagcctcctttcccgatctgagtccaggtgcctccttggccccagggctcccgagcacatgccctaaccatgactcagacctcattcctctgtcttctcagctggctggcggggacctggcaggtctactggaggccctgtctgacatgggcctagaggagggagtgaggctgctgaggggtccagaaacccgagacaagctgcccagcacaggtaaaggggcctccctggaaggtggatctggacctggagggccggaggcctgaggctttgactatcccattcctgtccccatttacccccagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttatggca

SEQ ID NO: 1888 - DNA, 6860 bp, Homo sapiens
cccttggtattttcgggactttcctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctgcccctcgtgtctgtccacctgtctgcccgagccccctctgctgccttacacctgtatgctcgcagatgctctcagcctgccagtctgtccatctgtctgcaactctgcctccaaaaggagctttctcttgggtctgaggaggaggggggagtgaccactgaagacttggagatgggaggtggggctgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtcctaaagcgggggagggagagcatgtgccctctctctgggggaggggctgggagatcgtggctcagcaaggtctctctgtccccagctgatggcccctacctggtgatcgtggaacagcctaagcaggtgagtgagcaaaagggagggtgtggaatggcttcagctttggggacaaatggggtagtggtagctggctggccatggaggagccattgccgaaggaggccacaggggattggatggtcactgctgctgatcagagtgctgtagtttggttcagggctactaccaggcactgcggtcactgctggcctgggtggtcttccctgatcacaatgctactatgcccttggaccttcagagaggcttccgatttcgatatggctgtgaaggcccctcccatggaggactgcccggtgcctccagtgagaagggccgaaagacctatcccactgtcaaggtgagccaggatggtgctggagggtgggctaagtggacagcatgcccaaggccctgactgacagtccctgcctctcctagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccagtaggtgccctctacgcctggcccccactggtatgcccgtctgccagtcccaggccccagcccacctccatgagcttagcatctgaccaaggggaaagatgtaggttggccccaaacccaagggcctaagtagaaactccaatggcttccttgaggaagtaaggctgagctgagccctggcaatgggaaaggtgcctcaggaagaaagaactgcatggccaaaggcctccgattctctcttctcagatttaacaacctgggtgtcctgcatgtgactaagaagaacatgatggggactatgatacaaaaacttcagaggcagcggctccgctctaggccccagggccttacgggtatgggtgcagggggtgggtcgggtatgggtgcagggggtgggtgggtcatgggaggtgctcatggaaggagcagggagggagaagcccaggggtcacacatgtacctactgcccagaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcagtgagtatcctgattgcctggggtgccaggcctggtggcagaggtggcatgaggggtgacctcaagctgtgcagtcaaacagacccaggtttcagaacctggccctgccacatatgagctgagtgatcctgagcaagtcatttcccccccgaagcttctgtctttagtaaatgtgtatattgggtgtttcctgcagctccaggggttgctgagataaggaatacaaagcccccagcttcttaaatgtggccttggctattgcatcatctcaactaatccatatcccactccatagaatctccgggggcatcaaacctgaagatttctcgaatggacaagacagcaggctctgtgcggggtggagatgaagtttatctgctttgtgacaaggtgcagaaaggtgagactggagcccactttgggcaccaaggacatcgagtataagactggggccagggaagctctagggtaaatggccccagagattccaccgggagctgtggccaagcttccgttttccttgtagatgacattgaggttcggttctatgaggatgatgagaatggatggcaggcctttggggacttctctcccacagatgtgcataaacaggtacccagggctagggcccgggcccgggctgggggctaaattaggctaaggactcactgacaccctgtgtctccctgcaccccccagtatgccattgtgttccggacacccccctatcacaagatgaagattgagcggcctgtaacagtgtttctgcaactgaaacgcaagcgaggaggggacgtgtctgattccaaacagttcacctattaccctctggtggaaggtggagctgggctgaggacctcagggtgctggcggggggccaggctgggctagaagaaggtcccaagagctagatgtggggatgcatgagccaagtcagaagtgcgagggtcccaggaggtgcttcctaggagccggccctgagggctcttctgggaagggcccctgaggcatgacacaataactgggctcaatctcattttcctctgcccccagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggtggctcacgcctgtaatccagccctttgggaggccaaggcaggcagattacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaaaaaaaaaaaaaatctgggagagtcatggctggtgcccgcttcccacagccctgcctgtatccacaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgaggtatggactccggggcacgggcggtcggggcgccggggctgaggacctagccctgacccacgccctctgtggcccgtagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacgtaggcaacagagggcctggcggacgaggcgcggggtgggggcaggaaagggaccggcacggaggcgggctctgcagttttcggacacgccaggcttcaagtccggcctcggtgttcacaagctctgttcaagctgcttggtctctccaaacttcagtttggtcgaccgtgcaaggggtacagtcatagcacttacctacctcaaaaggtgctgcgaaacgttaagtgcaggcacagcgatgccctgggccacgtgctgggttccatgggccccagcgagggagactatgagggcggtggggccttgaaagcgaaggatgctctgagtggctgggccagactctcgctccccaacccccagaccactgcacctagccatcatccacgggcagaccagtgtcattgagcagatagtctatgtcatccaccacgcccaggacctcggcgttgtcaacctcaccaaccacctgcaccaggtgcgggggcgcctactggggaggtgggaggggttggaaggcaagtgggtctcgggcctggctcaccctgctttcatccccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggtgagctccccatctcacctgactaagggggcaggcggggaccagggagggtatctggccagtgcccagaatggactatgaggtgtcgagattgaatggtcagggctggtccaggggctgccttaagggtcacagctgcaggttgagcatcctgcatccttaggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaaggtgggactgaggattgtggaaggagtggggccaagggtggtggaggggccaaagatggtgaaggggggggctggccaaggggaccatgctgtggtgtcaactctcgctgctcgcacccccagctccgggccaacgtgaacgctcgcacctttgcgggaaacacacccctgcacctggcagctggactggggtacccgaccctcacccgcctccttctgaaggctggtcagtctcaccctcaggggcacttgaacagggtggggggaagggagagaggtgcctcccagtcccccgactttgcagtccttaatgtaggcccccaccataccgccccatgacggcctccctctcccaggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaggccagcccgggactagaagtgctctgagtgacggggtccagagtatctggacttaaagacacaggcttaaggacgaggtgggaggtagtcagaactgcggctgtctccccaggtgaagaccttgctgctaaatgctgctcagaacaccatggagccacccctgaccccgcccagcccagcaggtgagaagcatcaggcatccccagcccgactcctctgactcctcacagaggtctcttctccttcaggacctctgaaggaggcctccctttctctaccctcagccccgtccatcacccctcatggtcctgtctgtcgcttaccttgggagaaaggcagtgttcaggtgtccatgtccccacccaactctggaggtaaatgacatgtctgtatgtgtgtccccctaagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgaggtgggttggcctgtgccctgccccctccccagcctcctttcccgatctgagtccaggtgcctccttggccccagggctcccgagcacatgccctaaccatgactcagacctcattcctctgtcttctcagctggctggcggggacctggcaggtctactggaggccctgtctgacatgggcctagaggagggagtgaggctgctgaggggtccagaaacccgagacaagctgcccagcacaggtaaaggggcctccctggaaggtggatctggacctggagggccggaggcctgaggctttgactatcccattcctgtccccatttacccccagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttatggca

SEQ ID NO: 1889 - DNA, 6855 bp, Homo sapiens
ggtattttcgggactttcctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctgcccctcgtgtctgtccacctgtctgcccgagccccctctgctgccttacacctgtatgctcgcagatgctctcagcctgccagtctgtccatctgtctgcaactctgcctccaaaaggagctttctcttgggtctgaggaggaggggggagtgaccactgaagacttggagatgggaggtggggctgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtcctaaagcgggggagggagagcatgtgccctctctctgggggaggggctgggagatcgtggctcagcaaggtctctctgtccccagctgatggcccctacctggtgatcgtggaacagcctaagcaggtgagtgagcaaaagggagggtgtggaatggcttcagctttggggacaaatggggtagtggtagctggctggccatggaggagccattgccgaaggaggccacaggggattggatggtcactgctgctgatcagagtgctgtagtttggttcagggctactaccaggcactgcggtcactgctggcctgggtggtcttccctgatcacaatgctactatgcccttggaccttcagagaggcttccgatttcgatatggctgtgaaggcccctcccatggaggactgcccggtgcctccagtgagaagggccgaaagacctatcccactgtcaaggtgagccaggatggtgctggagggtgggctaagtggacagcatgcccaaggccctgactgacagtccctgcctctcctagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccagtaggtgccctctacgcctggcccccactggtatgcccgtctgccagtcccaggccccagcccacctccatgagcttagcatctgaccaaggggaaagatgtaggttggccccaaacccaagggcctaagtagaaactccaatggcttccttgaggaagtaaggctgagctgagccctggcaatgggaaaggtgcctcaggaagaaagaactgcatggccaaaggcctccgattctctcttctcagatttaacaacctgggtgtcctgcatgtgactaagaagaacatgatggggactatgatacaaaaacttcagaggcagcggctccgctctaggccccagggccttacgggtatgggtgcagggggtgggtcgggtatgggtgcagggggtgggtgggtcatgggaggtgctcatggaaggagcagggagggagaagcccaggggtcacacatgtacctactgcccagaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcagtgagtatcctgattgcctggggtgccaggcctggtggcagaggtggcatgaggggtgacctcaagctgtgcagtcaaacagacccaggtttcagaacctggccctgccacatatgagctgagtgatcctgagcaagtcatttcccccccgaagcttctgtctttagtaaatgtgtatattgggtgtttcctgcagctccaggggttgctgagataaggaatacaaagcccccagcttcttaaatgtggccttggctattgcatcatctcaactaatccatatcccactccatagaatctccgggggcatcaaacctgaagatttctcgaatggacaagacagcaggctctgtgcggggtggagatgaagtttatctgctttgtgacaaggtgcagaaaggtgagactggagcccactttgggcaccaaggacatcgagtataagactggggccagggaagctctagggtaaatggccccagagattccaccgggagctgtggccaagcttccgttttccttgtagatgacattgaggttcggttctatgaggatgatgagaatggatggcaggcctttggggacttctctcccacagatgtgcataaacaggtacccagggctagggcccgggcccgggctgggggctaaattaggctaaggactcactgacaccctgtgtctccctgcaccccccagtatgccattgtgttccggacacccccctatcacaagatgaagattgagcggcctgtaacagtgtttctgcaactgaaacgcaagcgaggaggggacgtgtctgattccaaacagttcacctattaccctctggtggaaggtggagctgggctgaggacctcagggtgctggcggggggccaggctgggctagaagaaggtcccaagagctagatgtggggatgcatgagccaagtcagaagtgcgagggtcccaggaggtgcttcctaggagccggccctgagggctcttctgggaagggcccctgaggcatgacacaataactgggctcaatctcattttcctctgcccccagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctgggggaggccgggcgtggtggctcacgcctgtaatccagccctttgggaggccaaggcaggcagattacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctcaaaaaaaaaaaaaaaaaatctgggagagtcatggctggtgcccgcttcccacagccctgcctgtatccacaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgaggtatggactccggggcacgggcggtcggggcgccggggctgaggacctagccctgacccacgccctctgtggcccgtagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacgtaggcaacagagggcctggcggacgaggcgcggggtgggggcaggaaagggaccggcacggaggcgggctctgcagttttcggacacgccaggcttcaagtccggcctcggtgttcacaagctctgttcaagctgcttggtctctccaaacttcagtttggtcgaccgtgcaaggggtacagtcatagcacttacctacctcaaaaggtgctgcgaaacgttaagtgcaggcacagcgatgccctgggccacgtgctgggttccatgggccccagcgagggagactatgagggcggtggggccttgaaagcgaaggatgctctgagtggctgggccagactctcgctccccaacccccagaccactgcacctagccatcatccacgggcagaccagtgtcattgagcagatagtctatgtcatccaccacgcccaggacctcggcgttgtcaacctcaccaaccacctgcaccaggtgcgggggcgcctactggggaggtgggaggggttggaaggcaagtgggtctcgggcctggctcaccctgctttcatccccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggtgagctccccatctcacctgactaagggggcaggcggggaccagggagggtatctggccagtgcccagaatggactatgaggtgtcgagattgaatggtcagggctggtccaggggctgccttaagggtcacagctgcaggttgagcatcctgcatccttaggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaaggtgggactgaggattgtggaaggagtggggccaagggtggtggaggggccaaagatggtgaaggggggggctggccaaggggaccatgctgtggtgtcaactctcgctgctcgcacccccagctccgggccaacgtgaacgctcgcacctttgcgggaaacacacccctgcacctggcagctggactggggtacccgaccctcacccgcctccttctgaaggctggtcagtctcaccctcaggggcacttgaacagggtggggggaagggagagaggtgcctcccagtcccccgactttgcagtccttaatgtaggcccccaccataccgccccatgacggcctccctctcccaggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaggccagcccgggactagaagtgctctgagtgacggggtccagagtatctggacttaaagacacaggcttaaggacgaggtgggaggtagtcagaactgcggctgtctccccaggtgaagaccttgctgctaaatgctgctcagaacaccatggagccacccctgaccccgcccagcccagcaggtgagaagcatcaggcatccccagcccgactcctctgactcctcacagaggtctcttctccttcaggacctctgaaggaggcctccctttctctaccctcagccccgtccatcacccctcatggtcctgtctgtcgcttaccttgggagaaaggcagtgttcaggtgtccatgtccccacccaactctggaggtaaatgacatgtctgtatgtgtgtccccctaagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgaggtgggttggcctgtgccctgccccctccccagcctcctttcccgatctgagtccaggtgcctccttggccccagggctcccgagcacatgccctaaccatgactcagacctcattcctctgtcttctcagctggctggcggggacctggcaggtctactggaggccctgtctgacatgggcctagaggagggagtgaggctgctgaggggtccagaaacccgagacaagctgcccagcacaggtaaaggggcctccctggaaggtggatctggacctggagggccggaggcctgaggctttgactatcccattcctgtccccatttacccccagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttatggca

SEQ ID NO: 1890 - DNA, 3245 bp, Homo sapiens
tcatttgtaaaaatctgtttaataaatatacatcataaaagtaccaaaataattaccaacaatacattatgtacaccatttacaggagggtaacacaaaccttgacaggtagtaacttttcaccccacatcactgaacgcttaacactcctggctgttacatgtcacaggataccactggggtcagtcactcgaagcacaataaatataaaatgtggtccttccatgaaatttttgataaccttctccaaaaaccccacaaaggtgaggtttaaaagaagttttctcagaatttcaatgatctttctcgtcccctacaaaaagttcacaaaagcaacaaaatgagggctgatcctaccacaataagacgttttgggccaggcagtgtgcagtgtggatataagtacaccctttaaattttttcttcttttttctttttttagaaaaataaaactttttttttgtacaaatatacaagtccatgttctttcagcccctttgcgctcataacgtcagacgctggcctccaaacacacagtcatcatagggcagctgaaaacaaggggaaaaaagacacgttaagcttccggagcggagctctgccaagctaccgggatggggaggccactactggaaataactcttggactccattctccatagcccaaatataatgaactttacaggctgagagagtttgcctttaatgcttctctttaaaaaaagagggggggcaggtacattcttgggatactggttatgcacagaaatttgagagactcattatgtagatacccctctgataaggagcagctctaggggcctgggagggtgaagggaatggcacctcattagttagagcgccgaaggagttcacagactcacctcgtcctctgtgaactccgtgaactctgactctgtgtcatagctctcctcatcctcactctctggcagcatctgaaggttttctagtgtcagctggcccagctgctgctgtatccgggtgcttgggcggccccaggtgagctggtagggagaatagccctggtaggtaactctgttgacatcagccccacacttcaacaggagtgacaccaggtcaggattttgcaggtccactgcgaggtgaagggcagtccggccattacagggctcctgaaaccaaaaggaatttgagatgcttatggctgcatttggaatttctgctcacaacataagcacgaggagcctgactcagtgcgtcgggggcaggaagcaccaacctgagcattgacatcagcacccaaggacaccaaaagctccacgatgcccaggtagccatggatagaggctaagtgtagacacgtgtggcctggaagaacaaaaggaaaaaagtataaccacctgtttcaaccctcactcctttcacctattcttttatggaacaagtagtcttatcttctgaattttaagaacccacagtctgggttctgaaagaactttataaaggcatccaataggcactttgcacacatattttctcaaccttccaaatgttaggagtttaagctcttgcctggactccttaagttggcccacctgccccttctccacgtcacctgccctccgagggggtggggcagggcagggaggcagacataccattgtagttggtagccttcaggatggagtggaggtgcggggtggtgcaggactgagtcaggactcccacgctggccaggcagccctgctcacaggcaaggtgtaggggggtatttcctcgaaagtctcggagctcaggatcacagccagctcccagaagtgcctcagcaatttctggctggttggtgatcacagccaagtggagtggagtctacgaatgcaagagagaccagagaaagtaagccatggaccaaacccacaccccgagttcccctcaacccgtgtctcctggttgggtgctgctcctcctagacaggggggtggggagggctggcaaatagcagaggctccaggtgggtcataaagacctcaccaaatcagtggaatttccttcactctctaggatgtgggctgatgtgaagtaaaaggtgagggtaaatagtgctcagtggccctgaattcagaaaggatctggggtgactctgctacatcagctacgtcccagggtcagagagaacccgggccaggcaagcggcgcacctgctgcaggttgttctggaagttgaggaaggccaggtctcccttcacctggcggatcacttccatggtcagtgccttttcttcatggatgatggccaagtgcaggaacctgtggggaagagagggaaaaaccccaggggtggtgagtgcaccgcgtggggcccagggaggcgcgggctgcgggggattgcgcaaggccggggtttctggaggccgaggccgcggtgttttccgcgaggttattatgagctgagtgttcctggcaggcgcccagggactttccgcccccctccccccgcggccccggcgggcgccggccagaccgccccgccctcccgccagctcggaacgccctgtacttcccctcccggctgctcggcgcccgccagcggccagaaactcccgccccgccttatgcaaccggggacttcgcgtccccgctgccgccccgcccccggcctagaggacgggtctggggggagggggcgtgtggcgacgctgccatccaccagggcccagccgccgcccctccgagttgggccggtgccccgcgcggccctgcagccctgcagcgttcggggcggtgcaggagccccggggtgccgcggcgcccgcccggctgcatcgctggtcccccggctcgggctccaggcccggcgcctcccacccccaggccgcgcgcgtcccgccctcccgacgacccccagccccgggcctccgccacttacgagtccccgtcctcggtgagctgctgcttccagggctccgagccgcgcggcacctcctgcggctcgaggcggatctcctgcagctccttgaccatctgctcgtactcctcgtctttcatggagtccaggccgctgtcgtggcggtcgtccagtagccgctccttcttcagcccgtcgcgggggccctccatggcccactcctgggggcgctcggccgcctggaacatggcgcggacgagctgcgggcgctgctgcgggtgcgctgggccgcgggctgcgcgctgcttcctcgctggggcgctggcgggcgggacggcggcacggactgctgtgggct

SEQ ID NO: 1891 - DNA, 85542 bp, Homo sapiens
ttgttgttcttattataattattttattattgtttgatcatcttctctcgagacttgacatcaggacagaaacgccagtatatatacaggatatttgaataaggaggcatttaaccatcgaaagtaaataaaccagaaattggataggcgtggtagctcatgcctgtaatcccagcactttgggaggttgaggtgggcagatcactagagtccaggagttcaagaccagcctgggcaacatggcaaagccttgtctccacacacaaaaaaatacaaaaattagctaggtgtggtggtgtgtgcctttagtcccagttatgcagaaggatgaggcgggaggattgataaactaccccacgtggtagtttaacctgttgcctatactttggaaacaaagagaaaaatgcatccaagtttggcaaaggaaagcagcaatcacctatctgtcttgtgcccaccatcaagagagttcttgagatcaaagtttccaaatggagacttagctctggcaactgcagaaaagtttacgaagaatctgaaggaccagactgatggctagacttcatccagagacaacaatggggtgggacccagtgaaggaagtgaattgggttatgagttccacagcataagtaatcccaaaagcagggactgtgagtgctttttattccatgcaaaagagagaagtgggtctctgaggagtatctggggctggctggctagagacgctagggaaaggtagacaaggcttcctgagtgtgtggtgctttcttgctgacttgccctatatacctaaagtccatggtagaaacctgaacctacagaacctccaccaaaagagaggagagcacgggattctcagagactggcttccacttgaacagggaaggccaattccctgtgggcctgtcaacatcaacttcagttctctcgcccttacaggaggcctctgactgtatcactattttagaaatattgctgccatgtaagcttctttcaaggtgaagcttggaagctgttctccaagtccatcctcagcagctgaggccacaacagattaactgaagagaccccttggcttcttcctcttgacctttgacagctgaggtctctgcagagggcctgaagtaccctagaaaaaagggaacccaagttagtaggggttttgaaatagttccactgaaattaggaaaggaactttcttcctctcatggctcctggttaggatgaggcctttttttttttttttttttttttccacccaggctggagtacatgggcacaatcagagctcactgcagccttgaactcctgggctcgagcaatccgcctgtctcagcctccaaagtagctgagaccacaggcacatgctgccatatctggctaattttgttttttgtaaagatagggtttcacttggttgcccaggctggtattaaactcctggcttcaagtgatcctcctgccttggcctcccacaggttgtgataacaagcatgagccaccatgcccagctacaaagaggaggcattcaggaagtgtctgacataggtattttgaagtctatgtcagacagcaaatgcgatataagaccctaagcaggagatgtagattcccttctcccccaaggaatagcctcgctgactatcactggtcatcactggccatcaccggaagtgggataaggtgaaagaggagtcaaggcacatcattcgtacaagacctacagagaagggacaccaagggaagatgtgcaagaccatgactctccatctagacacctacaatttggagcctggtcacaaatatccctcaatatttttgaggcagtgccaatgaagcagcaattccagggaccactggcttgggggctataggtgccaactctcagaacaccatccaggaagctgctcatgactcaccgtggactctttctcaggtgctgagagggttggggctgaggagaccagttgttctggctggtttacacattggctatcgattccttgcagggaagcactgtttgaggtatgaggatctcctgaaatcagaaagatcaagagaagatagtgataaatgccttcttcttaccaggaagatattagcattcaccaagcattctgataaaggccagggtttggtacaaatatataagcagacagaagtagccacaagtccaacttccagctgactttcagaaagtcctgtttctgctatgaagatctccccaggcccactttcagcaggtaggatgagagtttcctcgactcaaaacagccagctgttcttctacatattccctcacatgtctcaggtatggagattaattttttttttttttaaagagatgaggtttttgctgtgttgtccaggctggtctcaaactcctggcctttcccacctcggcctcctgaagtcctgaggttactggtgtgagccactgcgcccagccagggaaactaatctttctcctggttcttttgctaacccttctaagtacctagaccagtgccacccaatcgaactttctgcaatgatggaaatgttctgtgtctgcattaacttggtagccaccagccacatgtggctactaatcacttgaaatgtggctactgcaaaagagaaaatgcatttttagttttatttcatttttattaatttaaacttaaatagttatatgtggctagaaaactatcatattggacagcataaacctagatcctaattgtatcctcacacagaccgggtacctctggagggctcaccagcgccttgatgcttctgtcccacttggacctcttgtgtggtgactgccatatacagatcctgcagattcatgacaaagggctttccatcaccaatgctgcatgcctctggcagtttctgtaagagagaggagatactgtcattggttacactgtattgctagagaagcgatctaataccccacatgcagaaccggcatcaaccccaaatgaattaatataaagcagttagatccaatagggggcgaccatatccaagcctggtggcaaccaatataaagatttcttgggacatctcctctgaagggcaactccaaatgtatatcttatttcccctaatccttaggtctattatgttttcccatgaataccctatagatttctaggctctttttccaaagggatgatttcttagaaggctattttaggaaattatttcccctaaattttccctgagctgaacaaattactattttcattaaattcattcataaactagagaaaaatgataaaattcaggataaaggagagagagcaaaatggtaatgacagactgagaggcaagaaacaattatggagctgtgatgttcaggcagaggagacaggaaaaacaaagctgacaaagcttttgaggcccccggccattttccattccccactgctgtcccaccctcctttactatcacccacatgctcacagtgggctggctgagattcccccaagggagtgaaaactgttcttgaggggtaaaaaaaactgactcttttaaagtataaagcgtgcacacacacacacacagtacataaatagattttttggtatacctgtggcattaaaatttcctgatagggagtgattaggcaaaaaatgtcttaaaaggttccttagggaagtgataatttttaaaaggctgagaaacactgctatgattacattatatttatctgtttccttcactacagaatgaactgtggacttacatccacagcaaaatactttgcctagttgtagtttcatacacttggctgaactgcgttgaggtaatggctgaagactgaacaaagtgcgataaaaatgagatgaaagagtagagtgtctagtggtcccaaacctggctgcacttcggaatcttggaaagggcccagaactatttcacctgtccctaggcgtgcaaatcaccatggttcccagccaagttagcaggtccccaagagcagccatgccagcagctcacatgagaaccaacccaagaatcctggattggcccataccttgggtcaagggcacctttttgtgctgtaagggcattcatttctgaaagccctctcatgggagaagaatagaagagagaaagtgtgagaagcaggaaagcaggtgctgaaccagtcaggatagctgaaaaccttgttgattaccaggaaatgtcacatacatttctactccaaccctatccccacaaagactatatcaggcctggactttcactggaaaccacaggcaatgaatcagagccccgagtccaaactttgcctctagccagtaatcacactagagtctaacagccctctggcagcattccctgaggaatgaactgaaacagggaaggtaaactatcaggccacaccacctctaccctacctcactctcaggagttcagctctctaactcccaagacaccgccttcaaaagagggttctctcctccatagccagagagccctgatggtggggaggcaaacagctgccctccttccttatatattgacctctagcatctcccttcatactacccaagaaatgatgcctctcttagggtcactcatacatgacttggtaggcactgtgctgtctacataaatgggttaggcagaatgaggcagtccagagtcatttcctcctgccctttccatggaatcaaacagattcatcaatttttcagggcgaccttcactcagctcaagtatttaacctcaaaacgaagtgctagaaatgctgcacctgggtctaaatgtggaacctaatctaagcccttccgctgtccttccccttctcagagagatctggtcctgcagttgctggcaaagttattccacctgactattctcagaaaagtcctaggaacagcatattgctagaattgtcgaatacttaatatatgctagacatggccgggcatggtggctcacacctgtaatcccagcactttgggaggccgaggcgggcggatcacaacgtcaggagaacgagaccacggtgaaaccgcatctctactaaaaaagacaaaaaattagccgggcacggtggtgggcgcctgtagtcccagctgctcgggaggctgaggcagcagaacggcgtgaacccggcaggcagagcttgcggtgagctgagattgcgccactgcactccagcctgggcgacagagcaagactctgtcttaaaaaaaaataaataaataaataaaaatatatatatatatatatgcttttatatatatacgcttatatatatatgctaatatatataagcttatatatatgctaatatatataagcttatatatatgctaatatatataagcttttatatatgctaatatatatgcttatatatatatatgctaatatatatatatgctagacattgctctaagtacttaaaatgtattaaaccatttttgtgttttctactactatttccctggcatctagaagaaccctgagctcacggtagaggctcagtactatgtgtgaatgaatgagcatggtaggcactagcatgaccccgtttggctgagatggtcccagctagtaagtggtggcacagggttagaggccgagcagtctggcttcagggcccacacatataattactatcctatttacttccctgaacagcagaattttggtcaaaagagcaatccagcttctcccaggatcacaacctgcaatccttcacatcccagatcacctgccatccggctgaggaacaagctccccaaggtgacaagaaaagggagcagataaaaaggagacaggtggaccagattggaccccttgggggctgagagaccatactcttaatcccattctagccattccccattatcacggattccttgggcctcattctcagaatatactagggaagagaggtggagaggcaggagcttgggaaagagaaacattagctcctggggcaggacaatggtagtggctacctggggcaggcggcagagatcaaagggagaatgctggagtcaggagtaagtaaagtaaatagtgccccctgctataagtgcgactgagccaggagcacgatgtaccggccacaatgcgggtcactgcccaaagtggggagggaaagaagagtcaggtcagcctacctgtagaacgtgttcatctgattaacccagaatcaattctagtaagcaaaaaagttactgagagtctactatgtgccaggcattacaggattcaaggcaggggaaacagatgcatcaatccttccctcataacaggtctgagttaatacaaagatagtaactcagagttcctacttcaaagagttcatatttgcatgtgggagataggcagacatatgttgttttgtttttcaagtgatttgctctaacagaattctcaacaaagggtaatagggaaccagagaagaagaaagggatgaattttgacacaagagttctgcaaaaagcatcagaggtggtgacatcaagacaagccttgcaaagttagactttggatgtgctggaagtaagtgaagcataaaggtgtgaagacagggtatgtggatgtgtctcatgggaagcaagactagaaggctaagttcacattcactagtttgcaaaggacttcattttctgaattaaggttatgcccatgggaatttctttttgtttcataaagtggctttctctactctacaactgtttgccaaagcttccttggctccaaactagtattgatggaacaatgaggaatccagagctgcttccaggcttccctttttagactctctgttacatttacctaaactcttagtacttcctcattacttactcatagtagtgtgattttttcaacagccacaagagctatattactctcccatctccaatgcactgggactttggaccctggtatacagccatatcagaaactttaggcaaaccaaagtgacagaaaccctgtagggcattttatttccccttcttgtccctactgcagcccatcttggttctgagggtccaacctcccctctttagaggtaactctcatcttcatggggtctaaactcactcccagtggtccagaaagcccaagactctctcaggatttgctggagagcttccaattagcattttcaactacaaatacgtaatctgcctctcctccctgcctcacccctcctttcctctgagactgtttcagaaaagaaacttctagaatcctgggtaagaaaggctagatctgatctactgctcaccctataaatatggacccacagtctgaggatacaggtttaatgaagaaaaagggaaaatgagctaactggagctctccagagtcagcctttgagcatgtctttggttctggcacccgccccagaaactggcacagccccaagcccctcgcactgaccatcacaacatcacaagggcagggcccacaacacgtgacttccctaagagtaagaattccgctcctccctcttgcaatgtggtaaacattgctggtctagatacaaacttccttcccttgggagcccaggtctccattcaaagggaatcatggcaatgttcaccatcagcttcccttaggaataagagcatattagaaaactcttctaaggtctcaaatggccagagggtttgccagaataaagagaaaggaacaagaaacgtaatttaggaagaagactctaatgagaaggactcttcaagaaatgtaactcccccttcgccaatccattcatatttaacaaatatttgctgatcatctactgtggtgtttgggattatttagatgctgggaatatggtagtgaacaaaagagataaaattccctgccatcttgaagtttacattctagaggggagatcaccaacaaatatatagctaattaaaatgtatactctgtgaaatggtactattaccatccaaatgaaatccctaaatcaaagataacctgaaatggccctgggtccatgacacagacccaactgcagtagtaaaaggctgagagtcagaaggaaagatgaacccaacatgcgaggatagtataaaggtttaaaaaagaaagtccaaagtaggttctcactcaaagaggaagaagcaaggctattcaggaattagaaaaaaaattactagaaaaaaaaaaaagaaatacactttaagttctggccttaaggtctcaaagatgtggatttgtacctaaggtggtcttctatttgctagctgtgacactgtgggaaagccatcatacttaacggtttattttgagagagagaggagggaaaggagagagacattgggagtcaggcactgagggatcaagactaacaacatttacatcacagaatgtgtgaaaggattaaatgagagaatcgagtaagtgcccaagaaatgtctgttccttccctttgcaaggcacattgagacttctcttgcctggccctactccaatgagtgctaagtggactcaagaagtgccctaatgataaagtacatagagaaactaggtctgatctaattacagatggttcctgacttaggatttttctattttactgatgatgtgaaagtgacaggcattcaatacactccttgacctatgatggggctatctctggatagtctcataagtcaaaaacgcactttcaactcaggatattttctttctttgctttttttttttttttttgagattaagtcttgctctgtctcccaggctggagtgcagtggtacagtctccgctcactgcaacctctctctcccaggttcaagcgattctcctgcctcagcctcctgagtagctgggaccacaggcacctgccaccacgcctggctaatttttgtatttttagtagagatggggctgcaccatgttggccaggatggtctcaaactcctgacctcaggtgatccacccgccttggcctcccaaagtgctggggttacaggcatgagccaccacgcttggttctgctattttcaacttaggatggatttattgggatgcgaccccatcataagttgagaagcatctgtattaacttctcttcactggcgtcccaaagcatactattatctagtaatacagtgaccagtcaaggtccagatcagggagacacagaaatctacccagtaacctgtgggtaattcactgtcccccatcaccacactagccaactcctcggtctctagcaatgactgaggcagcatggcttttgcatcagaaggtcctgggtttaaatcctggctttgccagttaccaggtgtgttactaaccccttttagcctctgctcccttaccagaaaaatgaggagaccaacagctactttgatgaggctgatggaaggattccatgggatgatatgttaaagggtgcctactcagtaggtattgtcttcctacctccccaaaatagcccctgcttctcaaagctctcctttactctccaattcttcaggacctacccaagaagccaaggtttcatcttcattctctccaccctcttttttgggtggcaagtataacagtgaagagtaaagctgctactctctccagaagcacacaaagcacaaacagcttgcttccaacaacattttagcaagagtattctgcacagcccaactgatcctgcaatgcttgaaccaagaactctctcaccaccatttcctgcttcctaatgtggcttgtgcaaatgctctgctatgtcatttccatttttaagtaatatacactcaataagggctatctggaaaacacaaaaatatgacctgcagatataggccataaaaatagctaacagtcaaatggtttttgatgggattaatttcacagtttcctcagagtctgagagaaaaaactactaggacagagaaaagagatagggtggtgatatctatatttttagaagacaactgtttcattctcctttctcctcatttcaaattttccacagctcatcacttggatgagctacctctgagtttcaggcaatatccaacctgatacggggtctctctctttgtcctcacagaatacccctctatcagttcagtgatcagaaaccttggtgatctgggagaaaatatagtaccctaaatacacaaggcacactgcccttgaaggtccgaatgtgaaactgaagacagagctaacactgccctgtgtttggtctgatttagctttgtttgggtctgtgcctgcaacaaggtcttccctgatcattctgccctgctgctgccgacctcgccatgctctatgattagcctccagctcctgagcatccactcagtgctgggctataaggaaaaagaacacagagaaacccaaacttaatcttgtgtttagggaccttgcaaattaattaaatcatagtcaactcacccccacccccgccaccttttaaaacaagatgggagaatagatgcagccatacagtcatatatgcaaacatctatgtatgcaatctagtcaagttactgaatcactttctttgtggcctcccttcaaaatgagataattttgctgcctctctctcacgatgctggacatgcaatggagtaagataggtgcagagttcaaaacagtttgagacaaagtccaggtcctacatatactattcagatttttctggttcagtctgaggtctggctagctctctggactgcagggtcagaagaggagggagatgtgaagaaagactataaaaagaggtccaaacagaaggcttgaataatattagtaaaattaactttgtaaatgctttctatgtgctaggtactaggctatgcattttgacacattactgcaattaacctccactgttaccctatcagttgggctctaaaatcattctcattttatttattttggggtttttttcttatttacttgtcatgacttgaagcccaatctcattttatatacaagaaaacaaaggcttgaagagattaagtaacttgactaaggtcacagcaaaatggggaaacagaaggcccaggaagttgaactctagaacctacacttgaatctctacactataatgcctcttaccaatgagacatccatttctccctcctatctcctacccctgtaaggaagttggtccctgttctgaggtctagtggtactagaagctggctctcacttcccttcttaaatctccaaagagctcaagaggctgaaagagggaaaagacaaaatgccctctagaaaaggaaagccttacttcaccccttgagtgtcctccaagtatagtggaaaataggaaaaatgaatctctggtatgggaagtctctagacttgaatctccttttaaaataagtacagcccctcagagtcatagcaggaaggcccctcagctctgcccccaaagaaaaataatggtaaagggagtggaagtgaaggtgggggcggggcagctgctctcataagagccctttgtggtggctgcctctgaaaggaggttttgctagacaaggtggaacttctcaaggtgacaagcaaatggtacagactgagctgtgaccctctgcttgctctataaccaccccctcccctttggagggccagagcctaaactgtccctggagccccacccagccccagcacaaaccatggctttctagtctggagggcaactaacgagcagcagaggggctcggggaacgcaagtggtttcctgggggggacggatcctcagagcccctcagaaagtgtaggagcaactctcattccttcttttctctactcccactcctctaagaagaacaagcagctcctgtcagctctggctcagggaaggggctccgaccagcctagcaggggaacaagcagtttgaacattattttagcacctctctcaaattcagccacctcaacatcctcttcccaaatggaagtgaaacaatgtggtagaaactggaaagaacaaaagcatcagatttaataacaaaaagaaaatcacagctataaggcagatagtctggctctgaaagctcttcatccctgccctgtgctactagcactgtgcaggagtgcagattccttttttttttccctgacttggtgcgaagagaggacagtcaactgggtgtgtagggcacaaagttgatttagagtaccctgcagtattctctgtaggacctccaccaccaaaaggattctctttcactccagattacacgcttgacagctgggaacacagcccacagcagccaagttctcatggactccctgcccccatcccgcctgctgcctgcctctctggagggtgacagtgtcttctctgccctgagaaatcgtactctatagggtgacgcaccacctcccccacctgccacacacactcaaaataaggtactgatcttcatgaccttgaggaggtaaagatttcttaacaggacacaaaccataaaggaaaaggttgataaattggactagattaaaattaagaacttctgttcatctaaagagacacttaagagagcaaaaaagcaagctataatgtaggagaaaatacttgcaatacatataaccaacaaagaactcatttccaaaatatattaaaaactcttaaaaatcagtaagaaaaagacttagtcatacctaaggcttagtcatatttaaatgactgataattacataaaaatgtacagaatctcattgagaaaattaaaaccacaaccggatatctctatatattcatcataatggctagaaggaaaaaggatgataatatcaagtgttgacaaagacacagtacaaccagaattctcctaaactgctggtgtggttataaattgatacagtcattttggaaaacagtttggcagtatctattaaatctaaaaatatacacaactatgacctagccattccacttctatgtatttccccaacacaagtaggtaaataagttgtggtatagctttacaataaaatattatacagaagtgaaatgttaaaagtatggctacaaagagcaacatagatgaatttcattaatatttcgggccaggtgagtggctcacacctctaatcccagcactttgggaggccgaggcaggaggattgcttgagcccgggagttcaaggctacagtgagctctgatcatgccactgcaagccagcctgggcaacagagtgagaccctgtctcaagaaaagaaaaaaaaaaaattaacattttattgagtaaaagaagtcatacacaaaagagtatatattattccatttctatgaagctcaaaaacaagcaaaattaatgatcatattagaagtcaggatagtgtagtggtgttaccctttggaggtggtagatattggtagataacaggggggtacttttgagtactggaaattttctagctcttgatttgggtgctggttacacagctatgttaattttgtaataattcttcaagctgtacacttctgatatgggcactttcctacatgcattttatacttcagcttttttttgtttgtttgttttttgagacggagtctcactctgttacccaggctggagtgcggtggcgtgatctcagctcaccacaagctccgcctcccaggttcatgccattctcctgcctcagcctcccgagtagctgggactacaggcgcccaccaccacacctggctaattttttctttttgtattttttagtagagacggggtttcactgtgttagccaggatggtctcgatctcctgacctcgtgatccgcccgcctcagcctcccaaagtgctcggattacaggcatgagccattgcgcccagcctatacttcaattttaaaagtttattaataaaagatgaatcactatggaaaacagcgaggtagttactaaaaatgttaagcatagagttactatatgacccagcaattctactcctaggtacatacccaagagaacggaaaacatagttaacacaaaaatgtgcacacaaatgttcacaatagcattattcataagagccaaaaagtagagacaacccaaaagtccaccaacagatgaatggataaacaaaatgtggtatatctgtacaatggtatattgttctaccataagaaggaataaagtactgatattcgctttaatacatgaaccttgagaacataatgctaagtgaaagaagccagacacgaaagaccacatactgtatgattccgtttgtatgaaatatgctgaataggcaaatccataaagacagagagtagtgatttccaggggataggagacagggtgaatggagaatgactgcaaataggtatggcatttatttttggggtgatgaaaatgttctggaattagacagtagttatggttgcataaccttgtgaatacactaaaaccactgaattgtatatacttttggtatatacttttcggtatatttcatggtatgtggattatagctctaattttaaaaacaagttttaaaatagataaagtctctattctccccatcttttttgcctattctccactctatttcctcttttaggaatagatgcttaggctcccaaaaggcttggacaacttttaaagaactttaaggcagtcagtggagcagatacctaccagtggctgagagactggaggtggcatggaatgttgaaagaccacaggatctagagtcagacagacctggttttgaaaataagtccaccacttacatgtttgttttatgatcttgatcttggccaagtgacttaattttttgagcctcaattttctctccatgaaatgagtaaaggaattcctactaatgagggctgtccaaggattgttaaatgagacaacgtaggtaacatattaattctgttcccttgagagttccatgcactctcaactgtttgaaggcaactgggaaaatcactttattccagcaaaaacagtgtgggctctggagttaaattgcttacactcaaatccctgatccactacttcatcttcatctctaagccttagtttcttcagctgtggaatgggaatgatattactgcctgcactatggagttattatgaggattaaatgagatcatgcatgtaaagttctccctatagtgcctggcacataggaagggctcaataaatattaactgttattattaattcaatcattaaacaaaattgccaaggatatgctatagcatgctgtgtcctaaggataagacagggttcactgccctcaaggagctcatagtctagatgaagagtgagacacataaacaaataattgttcctcacctctagccacacacgggagcctttgattcccagtcaacagcactaggtctgaggccttactaaacaaagctggatatgtaaggaacagcatggggtggggacagcagttaacagactaaccgtgaatcaacagtaggcccttcttttcccacaaatagcctacaaaaatctagataggcataaagactttctcctctgaattactactaaggggccatctgtgtcccccaacctcttcaagtgactggtttcttctcatctttcaagtctcagtttaaatgtcacttcttctggcctcctgaccatatcatctgaagtgcttttacagcactctattcattttcctcaagtgattatactttttagttattcatttactcatttcctgtcttccccattaggctgtgagcccctagagttcagggaccattcatctagcaaatataagtatctactatgtgccaggcactgaagtatgtgctgggaattcagtttgggggtagagacatggccactgccctcatagagcttacagtctgtatctgtggaaaaagttttgggatgcaggtttatcccaattccagctgaggactctcttaggactagcccagttagataggagcctttggctgccaatctctcactgagttcaaaaagccagaagctgaaacttgggcgacttctcagttcttttttccgcagtcctagattcctgtggagtttaagctagggtaaacagcataacctcagagccatttctgcaagttctttccttataaagctatttctatcagcattctaagggcaagcatggtcggtatcgggcaagaaacacattggctggggtggagggtggggtagggcatggggatagggaggcaagagtctccctaagtcctgtagagatgaaatgactgaactggaagtgctgagccctcagcgcctttcaaattctatgccctgaatttctcagatggctgcttcccacagtctaagcttctctaccattgagtctgacttcgtcctaaaggctacttcctgctaagctagcctgaggtctagcaatgttgaattcgactctaggaaatatattctgctgcaaactctctgaggaaacgccaaggggacactgttttccaggactgggagataacaaaattcaaaggattgttgaaaaagcttctttaaatttgttattaaatgaacaagggtatgtgtatatatgaagtatgtgtgtatatatgaagtatgtgtgtatataaaattaatgaataaatctttgcttaatagcaggagataatgtcctgagagcagaatccgggacaaagtttcaagccacataagcaaacagacctattcattcaagaactttttacttgacaccctctctgagccagattattctaggtacaaagaaataaatgactgattgtgggtttagcaaaatatgttcagttctatgatacaggtctatgtacagtctgctttgagagaagagcagaccagcctgggcaacatagtaagactctgtctctataaaaaatgaaaacttagccaggtgtagtgagtggcacatgcctatggtcccagctactcagaggctaagaagggaggattgcttgagcctgggagttcaaggctgcagtgagctgtgattgtgtcactgcactccagcctgagtgacagagtgagacactgcctcaaaaaaaaaaaaaaattataggattacaaaggaaaccaattaactgaaatgttattcaaatattttaaaactaatctgtaatattataacatatgagcttctttattaacacattaaatcatgagatctagcaatgagtctaataaccataatttcaagtagtaatcagcaaaagctgtatttcaagatatctgcagcagtataaaatgatacgaaagtatctgtgatttctactggtgacagatacttctaatatacagtgtcttttgcttacatttacaattgaaggaaatgctaaatttcagttacaggttaatgaaataaagatgcaactttccctctcattccattcacgaaaccctgaactcacgaacccagggtaaaaacccctgctgtaaagatgtaaaggctctcattgggtaacagtggatgcataatcagaaagaccacgtagagccagttcagagttagcagtaaggggagccaaagccacatgccagtcaatggtctgcaggagtagaaacaaattggctgtggggggcagagataagagatcttgagatcccagagaaagaagctgcctgtccagtttctgtgaggcatgggtagccatctgaaattaggtaccaagagacctccctgtgcctattcagtaaaacccgtttttacttaagctaattaaggggatttttctgccttacaattaattgctgagataatactttaaacaaaagtgctcactgaaacatgtttgtaatagactatgtatatgtgtgtatattaacagccttccagatgagaaattccttaatttataatcggttcagggtacgtatactctagattctgtaaagcccacagctgctgatttccataaacctgctgtagaaggtaccactgtcgaataccttagggaggagggaaagccacctgtcctctacatagagggctaccctggcaggcagggcgactaatcaacaggtagacagtgaactcgtaggagccagaggaaacggagcaggatgaacaatcagtaaagaagtcagggcactatctgaaactgtgcatctttaggtttaaggaggcaaggacaagagggatatataaatggccagaagaagaatcctaagctatcagaggtcctcttgcaaaatgtgtcttaaacagatttttgatattattggcaggggaaaattgagagggataaactgtgccctgaacacagaatggtcagtgcctaaactcccacaagacagatgtagatctggggccacttctgtggagaagggaacagaatgaccttccaggcctctccagctgctcttcccactgtttttaataccactaagggcaaacaggaaaggagaagtgactgggaaaggaactgaatgttactattaattaaatgtttaaaaatgcagttgaatagtgggtatatagtgtttgctttattatatgttctattgtgtgtattaaatattttatagtaaaaatattttaaaaagacacagtgaaaccaaatcaaaccaaacacacaaatggaaaatgaaattacttaacacaacatcagcagtgactactgaagtccaagcacggaacgtgtgtggaggaaatctccagcctgtgtcaatgcctggtcccactagactccaagtttaaagatgggcaaggattctgaggagaggctctagagaaaaattagtaagttctggatacaaagtcactttccaggaaatcaagactggcaggttttgaggtgaggaagtcgaagggacagaaggtcaactgctaggcttgagttatcggccaccagtttaacttaaaagactcattctcaacagggtacctgcctaacccatggctggggtggtgatggagggatctgatctgatctaaaatgttaggatgaccctaacatccagtgcctggggaaaattaagcaggacttactagccattaaaaagatcccagaaaaagatggagggtagggagaaaaaaagaactggaaattaagatatacttcaattcagacctcccactcagagcaggagtctggcagtactgtggaagcggaggttgtggctgggtgctgggagaaggggactggaaaaagagagaagtacgaatctgcagaggagtcaagataggcttgatttggaagaagttttcctaaatggatatgatcaggcttgaggctaagagctacttcctgagacttctagttccccggttcagaatctcttcatccctgtcctcactcctggctatagtccaggtactctaaaatgcccagatcatttctaggtgtagtacatctcacactcttttggatctaggtttcactaagcaggagagaatgccctggttactcaatttagcatttcctaactgataatctctccacttccttgcaggaagttatagctgtgggtgtaggattcccactgagtgtgctaaccccctatcctcaggctcacttaggaggcacaaacaggcagccctgacaccaggctgaccctacgcaacagaacagcactccagggttcatctccaggtgaggggatgaaggaaagaccaaatctaggctctggttacagggcatcttgaacacctgctaataataaaacattatctgtcaaggccttgaccctccaaaccaccaaaacagaggaagagggtgggagaggaattttagtccctctgatttttaccccaggtaataacaacaccccactccatcccaaaggccactagccagagtagaagagcacctaggaggatctaaagaaaagactgaccaaggtatgtggaagactgtattggtcccatcctagaaggtgggcagtgggtgtggctaaggaaacacttggctaaatcagctttcttcctttcccacttccattcagcctaactaccgacgtggcttttgtaagatctgtgagacagtatgtcagggaagacaatggaaacaaaagcttaccatgataaaaagagaccgatgcagcatgtagagttctaggccaatatgccgggtctccagttttgatgggtatatcttttaactgagagatgataaattatttagttagtagtagtcctgactgttaaaagatctcaccatcaagttcttagcatgtgtttctgggtgatattgtacaatgctttaaacctaatggtcacttaatagctgtctccttcccatatcattccccatataactgaaacctaagttaaagactccttagcctctgccaacttcttgtggccaggcctggactacttcaaggaagcccttaccacagggatgagagctcacagccaatggggagagcaccatccatagcagggattagtttcttgattaaattcttaagagcctaggatctagttcagggaggaggggtatgggtactattataaatgcaatcagagagctaaggggcaggtttcaaagtacacaggaaattcaaaacattttccaggaggtaatgaggaggactgaaagcagaaaaccagataaaagctggcgaagcaataaatgtatccatttgacaacatctgaattgggcctaggtagagaagctttaaaaaaaaaactggcaaagggtaagaggcttgataaaccaagatttagattcagggaaagaggtggagactcatattaaggggctcctagatacaaagcattctacatcatcaagaaacatttcctaaaactcaacatcaaagcccagaaatcaaggaatcaaacttagagagggccacttggagaaaggatacatggttttctaagatttccttctttctaaataattcaaggcaggaggaaagtgagaggacctatctcttgctatttacgtattttttaattctttgaatttttattgtataaagttgatagaactttgcaagactaatccctcaggagaagaatacttgaggacacaggagaaaaagagttggcaatgacctgggaaagattctgtaaacataaagtgctgtagagatatatgaaattactactcaattgactcagattttcagtcatttttgctccgcaatcatgcctaaaagtagacaagtattaattcaacaggtatttattgaggccctgctatgttccaggtactgttcttggctactgagaaacaaaagtcaacagaacatacaaaaatccctgcccttgaggagcttatattatagcagtcaaacaccatcaatattacagttatgttaggaaatgttcaatgcaatgggggaaaaaaagagtagggtgaaggattgggaatgtagggatgaaaaggtgggatgcaattttaaataaagtgatcagggtaggctttgatgagatgacatttagcaaagatttgacagtatgggaattagcctatggatatctggggcacaagtgttgggagcagagggcataagacaggagtgtgcccagggtgttaaacaaaacagtaaggtgaccaatgtagctagagtgaagtgagggagacaaaggtggtaagagatgaggtcagaaagattatagggatcaggtaagaaggggccttgtgagccactgtgacaactgtttttacttagagtaaaatggaatcccttgcagagttctgagcaaggaagtggcatgaactgactgagaactttaaagaatcactccagcttccaggttcagaagagattatagacagttcctggcttatgatttttttggctttacaatggtgtgaaagtgatatgcattcagtagatattcagggatattcaacatttcattataaaataggctttgtgttagatgattctgcccaacagaaggctaatataagtgttctgagcatgcttaagataggctaagctataatgttctataggttaagtgtattcaatacattttcaacttatgatattttaaacttacgatgggtttatcaggatgtaaccccatcataagtcaagggacatctgtataggagaacaaggatggaaacccagagacaactgcagtcccctaagcaagaaatgatggtggctcagaccaaggtattagagcagaggcagattctgtatttattttgaaagaagggccaatagaatctcttgatggattggatgtggggtatgagagaaagacaagagtcaaacatgactccaagatttatttgtttcagacacagaatcttgctatattgtccatgctggattcaaactcctgggctcaagagatcctcctatcttggccttccaagtaactgggactacccatgtgctccgctatgtctggctcaactccaagatttttaacctgagcaagtctgaaaggatgaagttgccattaaccaaggagaaggctatgggatgagcaggcttgatgtgggggttgggggtaggggagaagaaatgagaagttcaatatgaatatgttgagtttgacctattagacttccaggtggaaatgttgaacaagtagttgaatatacaagtctggggtttgggagaaagaactgggctgaagatacagggataaagatgatgtttaaagccatgagactgaatgtgatcaccaacagagcaaatgtgggtagagaatagaagagggccaacgactgagccttggaggtagtgcagaagagaagagatcagcaaagaagattgtgaagaagtaactgatgaagcagaaaataaagccaggaaagtgtattgctctggaaaccaaatgaaagtatgtcgagaaggactgggcgaccaactctatcaaatgctgtttgaccaaataagatgagagatgagaactatttactggattttgcaacgaaaaagtcattagtaaccttttcaagaacaatttcaatggagtgatgggacccaaaaccccatttaaatggttttaagacagaactggaagaaaaggaaggtaagatcacagtaaaaatagacaacacttgtaaggagttttgtagtgaaggggagtgaagatgtagggtggtaactggtgggcaaactggggtgtcagaaggatttttaaggtggaagaataatagtacatttgaatactaatataacaatcttatagaaaacaaaaacttagggagaggagaattaccagagcaatttccttgataggtgagatagaatctaatgcacaaatagagagacagcctttagacagaggcatggctactttatctttgcacacaggtggaaaggcagtgtctgagggtacatatgttagtaggaagtagaagtatggtttaagtctgcaagagttcatttctgactgattcttcttttttagggaaatttaactgcctggcagcattaaggctgcatttgagaggcagggtcaagaacttaaattgaaactaggcaggctgggtgcagtggctcactcctgtaattccaccactttgagaggccgaggtaggaggattgcttaagcccagaagttcgagactagcctgggcaacacagcgagagtctgtctctaaaaaaattttttaaataaataaataaaatgaagaaactagtcagcatggttttatgttttgctttctgactacatttgactgcataggtatggaggaggtagaaagttgagtttaactatacacaagaaatgggcaataaaatcagaagtgtgtgcaagggagtgattacaattgaccatagatgctgggtaaggaagggaggcagaatatcacaggagtcaggacaatgaaaaggaaggtaaggtcaatgggctggagctctctgtaggattaaaggaatgttgagtcaaggtagaggaagaaagccggcaaaacaggatggggatgtgctcggaaagtggcatgtttaaaactgagaatatggagaagtgcaatgattggtgattacaaggcctagagcagactctagaacagagcttctcaacagtggcactactgccactttgcgctggacaattcctcatgctggagggctgtcctgtgcactacaggatgttgaacagtgtccctggactctactcactacaccagatgccagtagcacttctcaagttatgagacccaaaaatgtctctggaccttgccaaatgttctctgtgggcaaaacctccccttgttgagaaccactgctctagggtatgtccagagaagtcactgaatgagatagggcaagagtcaacataattagagaagtactggagaaggcaatagtgagtcaggagctaaactcctcaagaaatgagtaggaattactcagagtcagtgcatttcataacagtgaagagtcctgggtgataggttcagatgcatcagactcaaagctgggctttttaaagaagagggaggagacatggtcagaaaccagcaattagaaataaggaagacgtgcatcccagctccatactcactagtaagaggactatgaaagaagaaacagccaccgtgtgagagtgcggcagaaaagacatgggaaaaggcagaaaagacatgggaaaagtctttaggggaaggccaggtttctcatcaagaaggagaaagtaatgctcgaggaagagactgaagataaagaagattttgctgattataaactatgaatttcagaaggtacaatggtagggcccagaaaccggggaagggtaggaaaagaggacagaatggggaaatgcaagctgtatttctgaaactggtaggtggcatccagtgggaggtccactgaggggaggggtggtatagtggaggcagatctttaatacaggagaagaaggaagccttcggttattatggcaagaaggtggacataaagtaagaatcttctgggaacatggcacatgacatattcacacaatagtcaggaatcactctgtaattaccaaccctaggctagaactagtttagaacaaaaaggatagttttctaaccttcaacagctttaatatgaggaagtcgaccaaacagatacaaatctatcaggacgtgagaacagggtcttcgaaggtccaggagctaaggaaaccttcaagaatggtgaaacttggctgtgcatggtggctcacacctgtaatttcagcactttgggagtctgaggcaggtggattgtttgaggccaggagttcgagaccagcttagccaacatggcaaaactcgatctctactaaaatgcaaaaaaaaaaaaaaatagctggggatggtagtgcacacctgtaatcccacctacttgggagactgaggcatgagaatcatttgaatccaggagtcagaggttgcagcgagctgagattgtgccactgaactccagcctgggcgacagaataagactgtctttaaaaaaaaaaaaaaaaaagcagcaatgaaatatgactaagaatacagagaatctgatctagtgcttatacacgctggaagagaattagaatgcagattcccacagggaccaagaatcccaccaagccagacagggttgaggaaagtaatctggacccacgaagctaaccaactgagctaagaagtagcaaagaactctatcaagataaagaattggtgctgggaaaattcatccattcatatttcttcctctatgggcattttacaaaattattttttaaatactaatcaatgtaaacactatagatgtatataaataaaagacttctactctttaactccaatccccccctcagaggaaaccactgtgaacaatttgatgtgtatcctcccagactttttttctatttggtataaacatcccaaatgggatcacattacatatattcttatgcattttgccttttttgggtaacagtgtatcatggctatcttttcaaggctatttatttacttatttattggggatggagtcttgctctgttgcccaggctggagtgcagtggtaccatcttggctcactgcaacctctgcctcccgggttcaagcaattatcgtgcctcagcctcctgagtagctgggattacaggcgcgtaccaccacatctagctaatttttgtatttttagtagagatggcattttgccatgttggccaggctggtctcaaactcctgacctcaggtgatctgcttgccttggcctcccaaagtgctggaattacaggggtgagccaccgcgcccggcctatttatttatttttgtgacagggtcttgctcagctgccaggctgaaatgcagtggtgggatcatagctcactgcagcgtcaaactcctgggctcaagcaatcctcccatctcagcctcttgagtagctgggactacaggaacttgccactgtgcttggctaactttttaattttttgtagagatggagtctcgctatgtttcccaggctggtcttgaactccgggcctcaagtgatcttcctgcctcggcctcccaaagtgctgggattacaggcctcagccaccgcacccgaactacctcattcttttttttttttttttgagacagagtcttgctctgtcgccaggctggcaggctggagtgcagtggcgcgatctcagctcaccgcaacttctgcctcccgggttcaagcaattcccctgcctcagcctcccaagtagctgagattacaggcatgtgccaccacgtccagctaattttttgtattttagcggagatggcgtttcaccatgttggccaagatggtctcgatctcctgacctcgtgatccgcccgcctcggcttcccaaagtgctggaattacaggcgtaagccaccgcacccagccctcattctttttaatggcttcattgtattatattatatggataagccgtaatttagtcatatttccataatgatggacttttaaaccgtttccaattttctgtattataaacaatgttgctggtgtttttgcatgtttaataattttatagagtacattcccactggctagattaaaggatatatttgacactgccaaaaaaacgccctcgaaaaatgtactaatataccttccaaccaaaattgcataaagtacccaattcctcatactctagtcaaagctgtaataatcttcatttttgccaactaataggagaagatcaactcattcttgttttaatgtgaactctttttttggttttctatattttagtggcaggggatatttcagtttaagaatactgaaaacttgctgggtgcagcgtgtgcctgtagttccagataccaggaggctgaggcaggaggatcgcttgagcccaggagttctaggctgtagtgcgctacgccaatcaggtgtccgcactaagttcagcatcagtatggtgactcctgggaacgggcgaccaccagattgcctaaggaagggtgaaccaacacaggttgttaacagagcaggtcaaaactcccatgctgattagtagtaggattgtgcctgtgaatagctactgcactctagcctgggcaacataaaaaaaaaaaagctgggcacagtggctcatgcctgtaatcccagcactttgggaggccaacacaggcagatcacttgaggtcaggagttcaagatcagcctggccaacatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaattagccaggcgtggtggtgggtgcctgtaatcccagctacttgggaggatgaggcaggagaatctcttgaacctgggaggcagagtttgcaatgagctgagatcacaccattgcactctttataaaaaaaagcaaaaacgggaaaaaaaaaaaaactgaaaactgttttcagattaggttatatgcataaacattgaaccaagaggatactatttttatttatttatttatttttaacttttttattttttcttttttctttgagacagagtcttgctctgtcgcccaggctggaatgcagtggcgccatgtaggctcactgcaacctctgcctcccgggttcaagcgattctcctgtctcagactcccaagtagctgggactacaggcacacaccagaatacctggctaatttttgtatttttagtagagatgaggtttcaccatgttggccaggatggtctccatctcctgacctcaagtgatccgtccgcctcggcctcccaaagtgctgggattacaggcgtgagccaccatgcctgaccaccattttttttaaaaacaaaatgactgctaaatggaaagaaacctaagaataacaacattacacatataactaatactttcaaatgcttctaatgtgccagacactatgaaaagcactcaagtatatctcattgagctctcacaactctaaagagaacattatccctattttacaccaaaataaactggagccaggtaggttaagtaagtttctcaaagtcacacagctagtaactaagtagagccaggtttcaactcagatcaccagactctggagtccccatttagaccaaagtcagctcaactgaagtcaaagagctagcaagtggtacagtcaggattcaaacccaggtttgcctaactctagagcacacatatgtaaggtgtttaatagaatttatattatctgtatgaataatgttatgatagtgttgggaagaacttattcttacccaaacatttttttttggttctggttttgtttttttttgtttgtttgttttgttttgtctcaggtttaaaaaacaaaatgacattgccttggttgaacaaagtcagggtcaccgcactgcatgaatccaggagcatcctactttatgagaatggaactcactggagctgtgccatgcacaacctgcagggccaaacatggtggccccaggaccaggtacagactgaaggaaaaaggggatttctgcctgcaactatgccaaaagagctaagggaaacagtgtgtcccctagtggttgagaacagtattgacagctgcaaatgtctagctagagagctccagaactgacagaattagggtagttgctgcagtgagatcagcacacatgaaaactttaatcgctgctctctctacccagggtgttcccttacaagagggtgcaagatctatcaaggctactctttgaagaatcagaggttccctaggaaacaaaggggaatagaggagaagtatcacccaaaacttaagtctcaagaataagatgcctacataataaacgaagagaacaacttttactacatgacagaaggtggtagagaaagagggatatacataaatagactcaagactagataatcaatgctggaaacttcgcagtaatcttccaaaaggcacccccccacacacacaaaaaagaagaaaccactagaaaattaagaaaaccttgaaaatgttctcaagagggaaaatgatgctaaaagaaacccagatgtggtgaatataaaatgaatggaattttggactcattcctactgtcagcctctcttagaattgaggcaaaggcaattgcagacttgggaagaaaggcttaacttgaccaaattaaaatggcctaaagccatgaagagaccatgggtaaaacagaaacacacatcagctggggtggcaggcaagaactcagatgtatcacaggaactcagggaaatgaaaaggactcaccaaggtaaacctgattatagttgagtgctgtcactgcttgattgagagggggatattctggttaaacacatcttctagtttagtatttaccatttgttctgtaagtagattactaattttcaaataattagaaagtatattataaaataaaaataacacacctcataatcttccagtaacatagggtgttaatcagaagtatcaactgtcactatagtctaaggtttgtgcagaatctggtctgttattgacttgtcaaagatatttctaagaagaaatatctagaaagatgtaggtggcaccagatttccactggccagacaggaaagagactttttttagttcaaagaacttgtacagtaagacatgtggttaattatcacagcaatgggacagaagggaaaccctgccacatccattttgacagctcactagactgcaagctctatgagaacaaggactttgctttggtcgctgctctgccactgcctctagaacagtgactggcacataggaggtgttcacgaagtatttaaagaagaaatattaacaaatgctgttccatttaatatgcccttttctcattctttcaaaaaaacctcttgaaataaagaatgaattctgttcattctgtctaatacactgtcttcctatcctctaattagggaaatctcatttatgaaggtccaactcaaatttcttctcttccttaaagtcttccctgatccctttctactgcctacaatcctccctccttcaaatggccagaattaaatcttccttattcattttcccatggtacgttacttggacctatatttgctctcatttcgttctatactgtatttcaattcagtatttacatgtccaattcttccatggggttataagctccttgaaggcaaggtttcagtttcagttttccttgaagatccatcttctaacataatgccttgcaaatagtaattacttaaatgtcttttaagtttaataaaatagaattatattcttggtgtttaataaggcaccagcatatactaagtgctcactaaacgttcattccatgaatgaatggaaagaaaggtaataccagcaaaactaagctgcctcagatcccaggactaggaggcatcatgccttgaagacagagaaatggtctttttctcttgggtctaagaagaccttgcctggctcctgcgcccaatgtcaggcaccctggcaccaaaactgtagagataagtttgaagaagttccagggagggtcacataattgacttggggtgggggaggaaaggataaaaaaggagcgattaggggctcaagttagacagatggcctaagtgacgtctgagactagacatgataaccttctgctaacactgggagagtgtaaacacccaagaggggaggaattgtttagcctggtccagtgggctcaaagtaggagaaaggatgagacaagggacgggagatcaaagccctgtgacagaaagccaagcaaaagagacactgctctccttggactcagagaaaacaaggccatatacattttcacagatatctacaagtgttatatcctcatcttcaggcataaaggaggcctacaacagatggattattgaaacctaatacaaagagcctatgcttggaacagaaagcccttttaccattatgcaaaatgtagcgccatactcaatgttattaaacagtgcccaaaaaacccacagattcagactgtgctcatcttcaagagaagatgagaaaagaaaaagtacagacagtcagcaaagcagtgaactggaatcccacagtttggtaaaatgcatgaaatttctaacctgtgttctcatttgctgttttccattttactctaacaaaaacacctctcaaactggcatttgctgaaaaaatattcattttttcctatttcccattctactccaagtcggcctacctgccttctagtacacttgagtgggcttcaatggtgcccacaacattgataatgagtgctgagagagcgatatagaagatatggtgtcctgcttcaacaagcttctaatctacttgaagagaaaaaaggtaagtatgtgaaaacagcaagaaaataactgcaaagaaacatatgatatatgcaagagaaaggaggataaatgagctatataactgctaatgatctgtcaaatcaggggaagataactgaactgatcattcagggagggcttcccagcagaagtgaaattttcttcctgaagaggaaaaatagaaatcgattgattgaaaccaatttatggtttacaaaagctagaaggaacctcagggtgtatctgatcaaaattgctcgtctgacagatgaaccccagggagcataataatatgcccaggtgacaaatcaaaaaagtggaagaactggaattcaaatcaaagtattctgatttcaaaacccagggcagatgacaggaacaaatgcagagaagcaagaaacagcaatgtctatcaggaagaaggtaagcagactggcatcgtggggacagaggaactgtttcacagagtaaggagaaataagaagccccaggctgctcccaaataatcttagttgctccatatggaccccacttctctctctgtcttcaggaacatccaccataccttaaattagtggcatgtgccctgcaggtatttcccataccacatgccctgctctggggcctaatctccctctaagggccacaattctcactcccagagtccatactggttctaagggctctagaagctccaagatatacatatggcaaaactaaccaagaagttactccacatacgaacttcttgttctgcttacagccccaccctcctcccttgccccaccaacactaggaaaccagatgtacaaatggttaacagagaaaaaaaaaaaatcccacccagaccacttgaaacgcggctagtctggctgggcttcgagtccgctcagcgactgcgccatgactgctatttatagcttctgggtgcccagcccagcttccaggtcactaattgtggcccagccccgagccaacccccacacctcctcccctgccctgtaacacagggaacaagaagaaaatctagctttgtccagcccaggaagaacagccaggagtgagatctgaatccaagaccctgtattatatgccttgtgaacagtatcaaaactgtcagaaggctctgccctccttccacacatcttgaagagctgagtgtccgtccttccacagcagcctcctttcctgaattctctaagttcatccagagttgaatcctgagttcagtctaatccatccaaatgctagagagtgaaagataggttttggctatcaaggacaccagccaacagttaagtaaagagcctatgtctttgagcaagcatctaagcacccttggattcatgtgtttgccttttcctagggtctatttgttagattatctgtccatttatttgtgttactactctagtcatccacaaaaaagtacccaggcaggaggcacgctcagaactaaacttctaaaaattcttttctagcacttaccaaatacattttaagttccacatattcttagtttcagacagaggacctgaataagatagttttatgagagtgctataaataatcccttctgattccaagatgctattatttgagtattattctataatactgttttccccctagagatacagattactgagatgggcaatgacccttttttggcatatgaggctttgtgaagttatcctgggtggaaaaaaaaaaaggtttttctaaggtataagagttaatggcaaaaagactcagtgaagcttactctgttagttctatacctgtgctacagtggggaaaccaccatgggccacattcccctgtgtattctacatctgaacccttgttcccatcccaattaaacttaaccactgtcaatgacatctatattcagaacaaaggattgggactagagatgaaagaagagttaagagacttagaataagagtgagatatctctttctttttccagtgccccagcacctaaactatggttaccattctcagacagaacaacaagcccccaaccctctacatccttgactgatgctgcctaagactacacatctcaatgccagtcttttccttctcattttggggttcatttgggcaactggataatatgccagggattctggttattggagccagaaccagaatgctgctgtgctatctcatcatcactcacaaataccaattcccagccccaaatggtcccaaatctttcctcccaagaccacaaaggataaaaaaaaagtttccaaattaaaaaactaaaactggcaacaaaggtgccccatggcagtaacctttaaaactggccattaaagtttataagtcagacgggcaccaacgtgaaggatcaagaagagaaaaacagccccctcccttggggacccagagccacagccttccccctaaagccacagagctgatgtcacaagaagcacttgctgcatcaagggctctctgtgtcccaactacaaccattcacaatgcaggcagactctgcgtgctggaggcgggctggtgtctggcagagaataaaggaaaggggaggggcaaggaggcgtgggttgggagtatatatgaggtaggcaaaggtgagaaaggagagaaaaacatcaaatctcctcctagccctcaggactgcctgcaattcacaggccaggaggaaacaggccctgtcagactgcctaagatagtggttctctttttccacctaacacataaaaggcataccacagattttcatcagtaacgacagtatattatgcaataatccttaactatcttggggtggatagttttttgatatgtgcatatcaaaaattttttggtaagggtatgaatagtttgaaaaggcttccaaataattctaaccatctccccgattgggtatgtaccccctatgaagaatcatgagcttaaagagcctacttttccttccctcccttccttccttccatgtattcaacaaatacattttgagagcttacatgtgccaagcattgttctattgacactggagagacagcaatgaacacacagacaaaaatccctgccctcattgagaatccatgtcttcacatggggtaaaatcaacgtaattaaaaagcagaatctaaggggtgcccactgcaccctgtaatcccagcactttgggatgccaaggcaagaggactgcttgagcccaggagttcaaaaccagcctgtgtaacatggaaaaatcccgtctctacaaaaaatatatatatataaattagccaggtgtggtagggtgcacctgtagtcccaactactcgggaggctaaggtgagaggatcgcttgaaccccaggaggttgaggctgcagtgagctgtgtttgcaccattgcactccagtctgggcaacagagtgagatgctgccaaaaaaaaaaaaaagtagaaatgtgtggtatattgggttatggtaagtgctatggagaaaagtacagcagagacagagacagaaagtgctggtggggtgggggtggaggtggggctgaaattttagatggggtggccgggaagtcctcaattagaaggtatcacttgaaaaaagacctgaaggaagtgaaggaatgaatcatgcagatatctgggaaggaccattcttagcagagggaacggcaagtgagaaggtcctgaggtggggcaccggtctcagatgttcaagaaacaggaaggaggcggccaccgtggatggagtccatatgctactgttcatcacagcgctcctcctccatttcagatcctttggctctgaggagtctgggctgactgcatgttggactgaactgtccaagccaggaacatgctcgcaagcagaaagaacttaaatagcttggtgaaaagggacatgggtagataagatgagcttagttttaaagtatttctctttactgaaacagctcaaagttcctttaaataaaacatcacccatcctcacaaaatccttgtaaggaacaaaggtcatattccttaactaaggaccagaggggggaaaatcattttaaagatgattttagaactggaatagaatttactcgtgatacccagaccaatgctctattattcataaaagcatagactactaaaaggtggaagccagatttatctcacccattctcctcatttactcaaaaggcagctgacaaaattagaacccaggtttcttggataaggggttaacactccttaaaaagcaaagtagggggatggtacagcttttaaaagaggggaccagctctcaaatcctgcattctagaaactctcctacaagggaaagatatggtgatgacattagcattacagaatactaataaacagtcttctctgtcccctgacccctagaaaaaatctagttatcccacacgcttggcccactccccttatctagatccctttagccccaaatgtctttcatgagacagtgtggccaagccagtgggctgcaggttctgaagaccagaattaagtctacagtgtgaatacagacacacacacacacacacacacacacacacacacagagagatacatacagtcagtgggaaagaaggggaaaggaaagcacacacaacacaacacaccagggcagctgcagaaaacaactgcttgttaagttaaaattaaactctgtacaaatattgacctttggaggggacagaaaccggtcccatatttaccagctttataaatgggactgaccacagctgccccacgcgcttggccagcatcatggcaggatggggcgaggccatgctttaggggtggggggatgaatgagaggggcaggagacattttaaacactctcttaaatgtagttactactggtaggtcaaagttcccaaaagccttaaaaggggaatttctaggaaagcaaataaggcagtctctgaaagtgggggtcagagaaataggaatagagtggaaaaggaaagcttcggcaaggaaaaattgctaaaaagaatgagaaatacaacagagattgtaactaaatggtgaaagcactggggagcttatccttttgaaccctggcccttggtcaaagcaagagtcataaggtagaagaccaggtgaccaatttaagtaacctaatggaacaatttaaactgacctggtttgagttttggctctgttgcttacttgctatgttaccttgggaagctcaaggaaccccagtttcctcatctataaaatagggataataatacaaaaatattgtcctaattcacaaagactaggaccaaccataaatatcacgcatatataaatcatcattataattaattccattccagctaactgtgccttttacactccaaactggccaagaaactgcagtctctccaggaacaaagtcaagggctagaaaggagagcttgaccttgccttgaacttgtaaaagtctcctaggggcacacacctagacccttctcttgttgcaggataacagggaggccaacctgctgaaacaggccccaaaagtcatactcaggttgcaaaaggtccagatatgaaggaggagaaaggactcatcaatactacttccctgaaagctgatctctagcaacctgaagtttttcaggaacaaacatcacagatgctgggcaacttagttctgttccaaacccctgaaacttcgccctcttttacgccctcctttacactcatgactttcacaatgaataagagtaagcagaaaaagaccagatccatctccatatgataggacatgaaacatgcacacacacatacacgcactgtgccaccaagaatcacaattctgaaagtatttccagtaaaaacacatgaaaagattttgctgaaattagttgcccagatttatagaaatctcttatgcctttatgtggtatattgtttatgctatacatcttaaaatcatggggtaggcaggcaactatcacggcatatgaaaaaggcaacgactaagtcaaagtactttacctcctcagtgctaaccaaacatgtgtcaccagcatctctcgactctgcttcacttgttcaatgttttaccttaatatattacagtttatattgttaaacgtgtgtcataaaatataaacaatgtacagcagaaccaggtcagcaattcaggaagaatttccaacgctgcagtctctgtggtcacagggcaagatgatttgcatttggtgcaccaaatacgtgctgaagcacaaactcaaaacaaattgaggagggagagatggacaggaatagaaaaggggaggaaaatggagaaactatcctccaggtagggaccagcttccttgaattctgattcaatatatatatgtattttttgtaatctgacatttttaccatcaagaacttatcttaaaatgtaatcattatttatctctataacctgctttctctggctttgtccttcttcagaggctccagataagtgataagcctccaagtttagccactcagagcctccaaggcttttgtcctgacatagaaaagagcccttacctcagtccactctcatttttctccccctccataagtcttcgtgtcaccttctataaactatagagaagtggagttagctggccttacctgtatgagcctaagatccttggcaaacctattaagctacagccagaactgctatcatttccaaggtattccatacttggaatacctttctagaaaagggagatttatcataatgatgaccatcacccatttaatactccaaaaaaagttcgtccctctcattctcagcaacaacgctcacaggagaagcctgaaacagaactcagtctatcacgcttcaggatcctcttcccacaatattctcatccaaacaaaaccaatgccttagacagggaagtttctaggctaggaaagtggggcaggggctgaaaacaagcatcttccaaagcaaaatattcttagggagaagttcacggctttgagcatgttaaggaaatctctgaaaacacacacacacaagcccacaaggggacaaacaattgtcatccagcaattagaagtgacatgtccaaggacactttgcttatgaaggggtctcctgactctccacccatagctccatctgtgagaccctgctgattacctcccagactaaattcaggctgcctacattcaactcgattcagcaaaatgcaaccccacagaggatttctagttgaatattgtttgtttcagtgatctcataatctctcctagccaaacttgtatatcaatctcagagaagtccctaagcagatcatgtgcctggactgattccttttagaatgtcttggcctaagcaagcaaaatgtcattctcaggggcttccagacagaagggcactccaacattgaagatgacagcagcataagtactccataggcctacaagaggtaatgcttacacaggcctaagaaatagaaaatggaagccaagatcccaggaaaatgctctgatgcagcccaacaagaaggacgagaaggggactcttacacagaaactgggtaaggctgggagcagactgcaagcacgaagtgacccacagacctggagaccagtgcccatctaattctgtatctggggcccagacatggcagaggtttctgattttataagaactatatctgtaatccagaaacaactaaatttcaagcatgctaggaagcatccctctactgtagtctctgaagtccctagagaggcaaataaggaaacattgctaccgggtaccagtgagtgctgccgacttaccaggcctaagaaatgtctgaacagagtcttattcaagccaagggaaaacgctgttaaaacacacaaaactcctttgactaatgtgagagggggaaagagcctctataattaacagaaactgtcacaggcattgggggcctccgacgtgttcaatgctaaccacttgaaaagacccggtcttctaggaggttggggtttgtgagtggggctccaacagactggggacagcttttccaaaagaatcccaccgtattttaaaaagaagaagaagaagaagaagaagaagaagaaagggggcagggggaggaaaaacccaaacctcagcttaatgtttttccaccagtggaactaaaaagcaaaaaagaagaagaaaagtccaaatgtaaccagttttcaattagggcctaattagaaagaaaagtggccatgctattacagatctaggaaggaagaaatgcagtcaatgactttagtttgggctgagccatccacttgaaagctatgatgattagagggataatttatggtgagagacggtagaggggaagggaggaacagaagaagagagcctggggggctgactgatcatgcaagtcaagagcctgagcaaatagtcaaaaatatgtatcgatcagccacaatctgcaaagcattacacaaagggctagaaggagaaacaaagatcacaacagatataactctgacctaaagaggcttataaacactgtccctgcaataagcacccacctcttaacactcagccactgtatacacatgcacaagtcttcagagaaaattcaacctcaacttcttttcatacacaaagtccactccgacaactcatgtgggctgtctccgcattttacccagctccctactcgtttgcaattatgacatacagagaccccataagaaaaagatgttatcacatcaaatataattcctggcctggcccggtggctcacacctgtaatcccagcactttgggaggccgaggcgggcagatcacgaggtcaagagatcgagaccatgctggccaacatggtgaaactctgcctctactaaaaatataaaaattcgctgggcgtgggggtgtgtgcctgtagtcccagctactcggagggctgaggcaggagaatcacttgaacctgagaggcagaggttgcagtaagcccagatcataccattgcactccagcctggcaacagagcaagactccaactcaaacaacaacatcaaaaatatataattcctgaatgaagtgattggatttgcctctgccctcaaaagaagccagtcaaggcctatgccctggctcaggcaggctgagacactgaatcaaaacggagaatctgagaacagctgaaagagcatttcttgatttcttttttctttttttaattaaaaataaaagagatccaagtaaggtttacacattgcaattggtggatataactcttaggattttttttttctttttgaaacagggtctcactttgtagcccaggctggagtgcagtgacgtgaacacagctcacagcagccttgacctcccaggctcaagcaatccttccacctcagcctcctcagtagctgggactacagacatgcaccaccacacctggctaatttttgtctttttttgtagagatggggtttcgccatgttgcccaggctgtctcgaactactgggctcaagcgatcaacctgccttggcctcccaaagtactgggattacaggtgtaagctaccatacccagcctttctgctttctttatgatcccaaaggattcaggtccattttctgtgtaaaggccataatacatgagaacaagcagaaagaaaatggggatgggcacccttgtatatggctataggaaggaaaggatcagctggttccattccacatttgcaataaacaaaccagtttgattgggagaggcatggaatactttctaccccttgctctggggtaccctctcctttgttgatttagttcaggcaacttggaggagggacaggaagggctagggcaaacatgtcacagcctgcagtgaatagagccaacagaaaggagaggcaaagaacagagctgagaggagaggaaaagaggagaggcctctcttcccatcccacaacctgggctccatccaacacaaagttaattcctaacctcggcttcaccaccctgcccactgcttgcatgatttatccccctatctgcctgcatcgcctttacaagcctcccagccctgcagaccattataaaagctgtctgtgctactggctcgacctggcctggcccaggctcctgccacggtaacccttctccaccccttcattttacaagccttccaccatcatggaaatctgaaatcccacgaaagaacagtaaacatcgcagggaaaagaaaatacctagccaggctactctggacagcagagtcccaaacagactgatgtctctaagccagggatgaaggcctctaggcaacagtgagctaccttcttgcctggactcacctggtcagtaacaaagagatgcacacacagatgccaattcttcatggggcacagccaagaatcctggtgccctgggagttcccaggctcagagaatcagccagaatgttggggaaacgcacaagtaaacacaggtgtcaggttcagagaaccatgtggaaatgtgaaattttaaataacagaaagagactaaacatttttcaaaccacgaactcagaatcagatctgtcgccttcttatgggctccaaagggaagtgacatggtgtagtggaaagagcataggctttcaattcagctgactgggtctgaaagctggcttcatcacttatttattagctgtgcgactttggacaactcatattttctgaatctcagttttactctgtatcatagaaaaataccaacttgtaaaaaggttgtgaagattaacgataagatttatagccaggatgcctggcatacaataggtacaaaaagttgtagctattactgttatttgggatgttagacatcctaaaatgggggtgtggtaagggtggacaggtcctattccttctccatgcaaatacagcctttttaataggtttcccctttattctatgcagttccctttctacaccagattccactgtttgatctcctggctagggaaagagccaaagataatttcctaggggagtattctttcctacccattgccatgaggacccctgccccttcatgactttgaactcacataacctagctctactcctggcccttcttactaggcccacattggcttcttcagcctcagtttataaaggctcttctttctcttcagactcctcaagagaacctgccagcacccaatggatttcattcttttcacgaaatgttgggctgccctactacaacagaccctaagccagaagtgagggttcataccttcctgaactaacatagtggagaatggacactaaggaattctccagtctctggggtccaaaatgctctgccaaggagactgagtgctccccagagctccgttattcacttgggggtaggcagtgggaagatggagggggagggacagggagggcaggaagagaagagagccttgattcagggggccagactgagtctgctacaggccaggctccgctgaggtttctcgggtgaaacacgcctctgtgatggctgtgtctgtaaagcggatggaaatgcccataaagccgtatcaaaccctgtgcagagaaggacagggatatatatagaaccaggaaccaaaggggccacaggggattcaggcggacagctccgcccagcccttaaacccgccccagggaagggggaggcccaaggaacaagctgaaggaatgaaggctggagacagcccggcgggcttatgaagggagtggggaaattaggggcgtcagagacaatgctggaagagagctaatgactgagctgtgggaatcaatggcggctggtgggagctggggcccgctccagcacacagacagatgctaaagggcagactctgagtttcagcagatcctggggggacttgaaccatctgctttggtgtcccacagtcttgacagtgctctgcttccttctcaggaccaacaaacctctaacaaaccactttccctgtcttcctctgcatcccaaccagtacctgcagtttaaattagtcgaggagccgatgttctccatgcctcactcccttaaccccactcccagtctcccggagaaataagagttgggggcaagtgaaaaaaagaaacctatctgtaaagaagtgtcctgaagcaagaaaagtatttcaagatggaaatctgtcaaaagacagaaacaaattcacagaaaagaaaaagaggctcacagaatgagacaatagtgtagaaactatggcatctggtggaattggccctaaaggagtcttgccagggacagaaagtgaactgtcttccactctggattgctgggatccccctctccccatcaaccttcctgtcaaatcaagacgttaagggtagagattccagtgatggggagctagaagacattaagcccacaataatttcttacctgagcaacagccagggtaaccaatcccccactcccccatccctatttcagaagagaatccctccccctcacaaacctgagtcctccccgccaccctgcccctggcccagcacaagtaggacaatgttttggcgccacctgctgtcctttcatgacaactgagtagaacagatctttgaattgagtggacctcaagctaccttccttaattcaccataaatcctaaaggaatttaatctaagagaagagaaaccataatttctattaaagagagtattcctgtggagcacactggagaaatccagtgctccaatcttctcctgtttccttggaccctaactagccagaacattctcataggatttttatatccagtcctacagctctttgtgacgttccttctccaagagtctggccgatttgagaaagacaaatactcaacaaaccctttctctacttaatagagtccacatattttgaaattactatatcacactgttttggctttcttggtttggcacagaaattcgaatttagcaccgagaggacatgatctagtgtttgtcatcaaacactaatgaacgcagtatcacccaaaaagcaatgacttagatatattatgctgctgtaccattcctatggtcttcactctgggcaaacattctaatatgtagtaagttcactgagcagtcacttcatctcacaaagatactttttcattcatttaacaatttctacagcccctattatatgccagccacaaactggaggtacagtggtgagtgagtcacacaaggtccatactctcagaaaggctacattctaggatcatttatctgactcaataaggtagtgtagcaatttctcattcatcttaaagaaaatgtaagtgaatagcaaagatcaagacaaaaatataaacaggctttggaaaaaggcaaaatgaagaaatataagaagaaggaatcagaatagggggcaatgaatgagtatataaaaaagtgttaatattattctttctggctatgttttttccctaaaccccattcctggacctaactctaggaactgcatgccagtgtccaaggtcagcttcctcagacctcaagatttacaggtctttgtagaaagaatgaagaagaggcgatatttattcaatacctaggattgctagcttaaattatatgcaagtatttcccccaaatgtcaacttgggaaatatgtggggctccatcaagtatactgccatttgtagaagagagaaaagtctctgatcggccctagtatgagccaataaatctagggaaatagagagccaccaaatcttagggctagccatgtcctctcctaacctcgtcctctaattgttccaagcaggactctactatactgatcattatgtaaagaatcttaaagaaacagctcaggtacagtggctcatgcctgtaatcccagcactctgggaggctgaggtgggtggatcacttgaggtcaggagttcaagaccagcctgaccaacatggtgaaaccccatgtctactaaaaatacaaaattagccaggcatggtggtgcatgccggtgcatgcctataatcccagctacgtgggaggctaaggcaccagaatcacttgaacccgggaggctgaggttgcagtgagccaagaatgcgccattgcactccagcctgggcaacaagagcaaaactctgtctaaaaaaaaaaaaaagaaatctaggaaaggagttcccaaagcttccctagtaacataatctagtcaggtaaaaattctctctacttcaactacatccttataattcaagtttatcccttcttgtactatcttgagcaaaatgcaggaaagctatttactatcctatatgtgttaattttccatatttaaaagaatgaactaccattcaatctactctctgaattaaataattccattgtccttggatttttcttatttatcctatgtccacctcttttattattgttctgattttttctatgggcattaaggcccccgtgcatctttcacacgtgacatcaaaacctcaagagcagctggacacagtggctcatacctataatcctggcacttcggaaggctgaggcaggtggatcacttaagtccaggagtttgagaccagcctgggcaacatggtgaaaccccatctctactaaaaatacaaaaaatcagctggacatgctcctagctacttgagaggttgaggtggaaggatcagttgagcctgggaggtcgaggctgcagtgagccctgattgcaccaccacactccagcctgggcaatagaccctatcttaaaaaaaaaaaaaattaaattaatgaaaattgtttaaaaacctgaagagctcaactaatgctaaatacaatagtagggtggcttggggttttcatgctattcttttaattatagtctggaattatattcatctttttaaatacccaaaatataccaagaactatatcgcaactgggagctcttactagttaaatctttcaagaaaaaaggtggggcaatatctcccacctaaggagtagaagaccactttataagcaagaagttctattcaacaagagactagaccacaggggaaccatctgacagcaggagcagcagccacggctggtaagtagggagcccaggagggtatttacagccttgtggagggttattcaagaagtcacaaaaattttactttactttccttagatccacgcacctttcaagagctccctggggatctttcactaatttccccaccagggaatgacttcctcatctgtcctcactgagcacttcatgtttgtctttattacagcactcttactttggtaagataagtgtgtgtacacctatctatctcattttctgagccatatgcttcttgggggcaggaatcatgttagttatctctgtacccttggcacagtaagtacttaaatatgttagtttcctatcccccatagtactggtacaagaacctaaacccagtggtattcaataaatgctggataaggatgataacattaataacagccattcagcacaactccactaagttgtcagaccagtttaggatattggcatgaaaaatgctttttctcctggcccagacatttactcttaagatttgcctcctcctcaatagactccaggaaatagggttagttttaagttctagaaactctaatcattcctgttttctccaaactaagggcctgaaggaagactgcagatacctcatgaatattgatgagcctctgcggtcacatgaatattaacaacaccctgtggctttcgggaacagcagcccagctagaaggtctaatattaaccttggctaggcccaaaaagtagaaagcgcatatgcccatacatccccatggggagtaaagagtggatagcggaggccagtttggagcttggcccctatgcaaacactgggcacacaggcagttaagaaagaactaaacattgtgtcctacgtccctggcactggggggctctgttagtagctacccaggcaggaatccccaattctcaagctttggagaagttaggatgtagaggctaaatcatactcaattcagaaaaacactggtagggatacactgacctagttcaatagctacagtagaggggtaggaaaggttgacagtcagatcacataggacaaaaaccagaatcaaattacaaggctcaattaggcaacaaagacatattttgtagatcacacattaacagtaagtaaagttctatagactggagtttccagccccataccctcccatgagactagtggacacagaaaacaatgactgagacttaagcggaaagctattctacgactgatgcagtgagagacagaaggagtcagaatctttttccacctacagatcctcaacccaggaaacatcagaaagaatgatgatcattattaaaaacaaacaaaaacaacaaaacaaaaagtactgtgaatcaaagttaaccaaagaaacccatgtacgcctagccctgggtctaagttcaaaatctacttctatgtcacatgacagaactattaaaaggaaaggcaggttaagtaaccccatgcagtggctggaattaatgctaataagattcctgctgtactcatccaccaagacagactacatttaaaactagaaaagtgcgtctttactcctctagcctgatcctactcaaaggccttcaccccttagctctgcctgaaaagctgatccgaccccctttacccacactcaagaggaacagagaggcctgtaggcctagcccaagctgaggtggtgagaggccacacctaggaagagggtgggggctactctcaggcgctgtgttctgtcacacaattaccatattatgtagctctaataaaaagaaatacttgaagttttattagtgccatataataaagtatttatagaatcctggcggtgggggcagaggtagagagagggagaaggaaataggaggaatcgaaattgttagcaataaccctagcaatggcagcccccagcattcgccaccctgggtaaacctcaaagacttcagcctgggacatcaggccagctgtcatcaacctagatcagcatggcttactgttcactccctctacaacagtccgtctctgacttcttcctggttaacaaagaaagaggtgaggaactgggaggagtagggaagaggaataaagaattgatatcagcaaaactgtggagcctaggcctgaaaaggctgggaagcagaggaaagcgggcatcagttgaaagaatgagtggaatgtaagctttaaaaggttccattctggagctaaatttgagttctcaccatccagcatatctgaccgttttgaaatttgcccaaacagggttttccattactgcactggccccttctgcacacctctcatacacccactccaaccacactctctactcaccaccaccaccacgagaggagtgcaccccacacctactccaaccacatgacacacacccacaccttctcccacaccgcccctcctcacacatggtcctcacagccacagtgcacacacatacaacacactcaccacagcacactccttcttaaggctaccagctgcctgcatttcctgggcatcttcccaacttaagacacatcctagataaaaacattttcggagtctacaacactctttaacattttaaaattttctattacccagaaaatctccccaaagagagagagaagtgagggctgtgacattattacagagaagactataaacagaacaaatatagtgctgctttattacaaggcagtgtggggttggtggctggctgattacagggccactccccagagctctctgcagtcccagacctcaataaaggccagacttgagctgccttcaactgaggggcccccttcagattccagtccaggatgtgctatctgccttggttgaagataaggaggaaagcaaacacaatctaagaacaaccatgcttggcaaagagccacttgaccatcttctcaaaggcaaacacaattaagatggtttgggtttcttggaatcaatagattccaaactttggaaattaaaaaaaaaaaaacctagagagatcaagaactgatagacttaaaaacccatacacatcatagatagtgcagagtaagggggaggaatggattagaggacagaaagagaagcaacgcagcttgagtgactaaagcaacccatattacgcataaaatcatagaaggaaagagtgggaaatccacaagtcctctcttctgggctctgggcacacagcgtcccttcttgggtgactcacactgggatcaccttcacccctgcttcatgtggtaagggcctctttataaggagacacaccacgagccttctcctcctccacccctgcgagccagggcaattgcgtcactgacctccacacacactcactccctcctctttccagccggccaccacacaagggatcttgtcttgtggtccctgcgatcctttcatctgggctccaaacccactgtcaccttggccctgaatcactccccaggagacactgggaaaacagagctggacaaagagtgtctgggtcctgtatggctagaatttactgatccctgccggtgagagaacccaggctatgctcttctctgcccaaaggcagggcacaggagtaatttttaacttggccttgtggccagccctgcctacagactaggtgtccactgatttgggtgatacccagcccccaacagctaaaggataaaaagggctgagaggcagtcctaaaggttctagctcctctgccttacttgttccgtggctgaggaattgctagagttggaagagtgccagcaagtatccccccagttctgctctcatcccacttggctattctgttctgagggtagccccaaggaaaatattttggcagctgaaaatgtcactgtttcttagatccttctccaagatagaggattccctccaactgtgtcttagctcatttccatgtttcatggtcctaacatttttccttgaccttctgtgtaatgatattccactttgggactttgccatttttctgtaatttcagaacctgtggttcaatgggcagattttaggatgagttacaggaacgctatttactgagttttctcccttttcaaatatatttcattacaacaaagcctctaagatagcatgggataatggggaaaagctctgcactagaaagtcaaaggacaaggttctgttttctacctattacttgtgcaactcgaggccgttcaatttctctgagccaacccatcgtacctcctcatccttaagtggccctagtgggctttcaaaacaaacaaacaaatcctcaaaataataattatgtcaatttggtcttctttttatctgagtaggtgatcaatatatttgtgttgaactttacccaaggaagcctgctcattttaccaggcagttatgcgaatcaaatgaaatcaaaaaggcaaaagttctctgcagaattcatagtagtacaaacattcactgagtgtttacaatggatcagacaagttaaacaagacatcatatccctgcccttggggaacttaccacctagtaggaggagccagaaaaaccagtaattatagtacagtgttgatatggcctacgatagagcaaacagaatagcatataagaagggcaagtaaactgaactcagagggccagggagaattccctagaggaagtaacatattcactgaaatccaaacaatgaacaggagttacccaagtgaaaaggtggaagggggtttccagagggaacggcatgtgccaaggactagaggtaacagaatgacgggctctagcaactgatagcagttcactgtggcagaagtgtagatctaagaagcaaggtggagagtatggatggggttggggaggagggggttagtgtggcctagcagaagagtagcagacgaagctgaagatgtaagtagtggccagatcataagggccttaataatctttttaagaagtttggactttatcctaaggacagcaggaagccactgaacagttttaagcagggacacatgaccagatttacgttgatcagcaggttccatttggcttcttttactgattgtagatccctggggctagggaggtgtcaaaaagaaaagaaccagaggttcagacgtggcctacttcttttctttccatggaacccagcaggttcccactcccttcctcatgggactctccagtcctttaagtgcttagcttactttccagtcttccctctcagtcagtccccttactcctccctctttctctggcaaagaaaaaccttttatgatgtggcaagtcctttccaatcagctgtcctattgacctgggatattagcctcttttcttgaatattatcccctcaccagcaacctccaaagagggctgtcaagtaaccctgccagtaatccacatttctaatccaaggcccatttcttatctcttacttaaattccaccaactctgccaatatttacttttctcctcaatccaagatctctcaacctctaaaaacaatttggtggcctcctaacagaagaccaagatatgctgaccaaacaggtgatcaatctgaaaggcctcataagaaagaccttatatctagatgataatgataaactagcaaatgaactctatgaaaacattcattccttttctttcttccttatctcctcttaaactgcagtttaaggtttagaatcaatcccatacaggaaaatcatcatggtcattaattttatctcttggcattaccatttaaccttagaatcaaagaaccttggcactggaaaataaacctttagtccaatcttctacctcagtgtcagagctctttggtatgacttggcaattgagatcagattgctttttactgcctgaaatttcctgagaattccttttcctactcatccccactgaacaggtttagagcaagacctctatatccattaggaaatagctcaactcatcaggtcttaaggttctagaacaatgctattcaaagtatgatcagcaaactggtgagtgctggtctgtgaactctttgtaactagcccatgatgcggtaagtatagaaattgagtgtaagcattttaaaacttttaaagcaacttgacattaccaggacatcaaaacatgtattcagaggacttatctcaatgaacagcgtatcaaacagtttgagtactattgaacttgtatggtaagtcacatatggtacatgctgcatactagttaggcacattaagaccatatgtcagattactttgaaaagcactattctagaaagttttcagaagggaagaggataggtctggtggtaggggggctagctctcttctttttttcccccttctgggtacaatagatagtgaatctgctacctcggatgaggaacaggaagctgctcccaccaagccactgactgcatggggtgaagaggagggcaggagttggcggccaggttatcaggcaataacaaactcagcatccaagcacgcgacttccagcaatgcaaggagcttcctttgttttgggaaaacaagagctgcaagaagcctctccttgacacgttcttgcccggcctcaggagaagcccaaccacccctgacacacaaataggagagtcctggccaatgaccggccagccagaatcctgaccacaacccctgtttgcttttccttttccaccacttcctcagttcgagggccactgtggggccataggtagctgccagcctaggtcacccttcaagaacttcacccccaatgacccagtacctagtccatacaactcttccaatgcacttcctatagcctactttctatcccccatatggtttggtctaaaagcaaaggcttttggccccttccctagagttgtaggtaaaattaagtcttggaataccactctaacaaaggccatggtatgctgtaccaaactaaatccaagaagatcatcatctaaccaagtgcccaagaagaacaatatttgaggcttcaatagaatattctgagcaactatttttacctaaacagacttacttgattgcattagatcctcaacttcaagaatccagttatcatcaagactaaaatatgtaaaacagtgcacctatgcatgatgcagaatgtcaaaactaaacttccaaggagttagctaggaagtttagaaccaaagatcaaaaatccaacacctgggagcctagttcttggaggtataaacagagtaagagtctcaactctcagactcacatgaaggtgccatctaatctaagatgaaagactttgggacattttctccaagagctctgagaagtgggactagcaagtcccacctatgactttactctgataaatcaagaaccttggggaccagcaaaccttcctccctctctgattaatcaagggagcttactctttatcctgacggtccaagagcccaagtttctatgaagactaatttgtcctgtaaggggagggatgtcggggcgggactccccccactccaggcctccttcatgccaaagaaggaggaaacagaataagcaaaataaaattcataaagcgaagcagtaattatggtgtggtcaacaagaggctgctcctcaggcccatcattatgtggctaaatttaacgccctgcgcggccaggggagccgtgcgccccgggcaccgtgtgtccacacagacgccagctccgccaccttcacccgttcgacagccgccagggctgccagaaagcaggtcacaattttttttatagtctgtttaccaagatgctgtttttactgccgaggtttctctcattttatctctttttcccttttccccaaacagactagcctgtattttctgtcctgttttttttttctttctccctctctcagttctattttcagaactctaattttatatggtatgtcccttcttttttttttttttggtaaatatttgccataactaagccaggcacatccagtttaaaaggctccgtcccacaaaacatcaggcttttaatgatatgcatctcattagcgtgtcctatgaaagggggtatagaaaaaaaatgcaacttacagactttctcactttttatatctagagagacctatatttatatatgaggacaagctgaaaactgacattctgagccccaatacaaggctagtacaatggtcatttgattcaggctttgagacctcagaagcagtttcaggagagaggggctgtaatactgctggtcctcccaggtggttctgacaaggtaagtacagctagaaccagtcctcagacccagaggtattagggctctcaagatcagaggaacaaaactctgggaagtcctctgacacaaaatttccaaaaacggctgtaagaaaacagagcggtaaatagggcatcaatatttccctccttctctggctgataagttaaagaaaagaaagttatgagttacgagcgcttggagagatcctttccaagctagaacttccacatctcccatttactgtccaaaggcttctccagctgtgcaaagccccagaattgaagggaagatttttctgtacatgttaggttggatgaaatgggttgtatggttgagtccacttacggtactgaacaaaagacacagcatcaaataagcactctccaaataatagtctgtgatgtgcttttaaatccagtgtgaggctggttgcagtgcctcaggtgtgtaatcccagcattttgggaggctgaggcaggaggatcgcttgaggccaggagttcaagaccagcctgggaaaaacagtgagacccaggatctactaaaaataacaaaaacatcagctaggcatggtggtacatgcctattgtcccagctactcgggaggctgaggtgggaggatcacttgagcctggaacatcaagtctgcagtaagcaatgatcacaccactgcactccagcttgggcaacagagcgagactctgtctcaaaaagaaaaaaaacaaacaaactgcagcttgacattctaagatggtgttagaggagcccccagcattcagtgtttttgataagacatgttgggggagggaaatagatacatgaattgaaagaccctgcatggctgttcaggtagcacctcctggggactctatacattgcgggggtcaccaaaggtccagagtctctaactcagtttttattagttcatttagggatgttcagagtttagaagactggctgatgttaactaaaaattataagagactaatttcgaaattaaaatgccaatttattagtttacaaggtgaagtctagtccagttaccaaaatatcttcggctgctttttcctgggaagctgaataaatattgagagtgctacttgttaaacacaggaaaagggcaaaaatcggcaaatagcttcagggggtagtttacatacattgtgcaagctagatattcatcttgttctactgtatcactgttttggcattgtgctagataaattaataaatagttactccttggtttttctttttttggattctatacaactctgttcctctgttagtacatttcctcacacatcattaattaattacataaaagtttttctttaattgcttgtaagagtctagaggtgtacaagactaaaagtggcaagaaaggaatgtggaataagaaaagaggcagtacttggggcagagcgctctagctttgaaccattttcctatattttaagttaggtctctatactgctcacaaattggtctcaatcttgcctactgcccagaaaacttccaacaggtgtaacacgtggcaaggcaatctgacatgatggaagaatactggaccggaaggtcagagtcctgggctctggtgccaaattccacaattgtttgtctatgtagagttattttatccttatggaccccaatttccacataagtaaaagagagtggcttgatatagccttagactgataaagtcacttcaaaattccgtggctctaatctggacaaaatatttcagaggctataatttccttcattgagctactggcccaggcccttgagatttgtaatctagtttcatgagcaatgtatttataaactgttggatagattactcagtagatagctaatcttatccattttatattgattcttctttatatctcagtatgagaggttaccccaaatttagggggggatactctgcttaagacttgcatttcctatgtactcactaaactcagcaatttcgctatgctcttcccctagctgctgggggctgcagaaaacagaatgcagttgccatcaactattccttctttaaaccaagcagtattatcccatctcaaaatttatcttcattgttagctttacccatatcaaattagaaggggttctctggagtaaaagattctaagagagcaatccatagcatcagaattgctcaggcttcaagcataagattaacaaaagccaaagagcttttaaaggattccctcaaaccatcacacttcaggaaagccccttagattgtgtaactcagtgaaagatctagctgtgtcttttccttcagcagccactctccatacaatattcctctgaactcttacctcaagagtaacttcttccaaaaatacttttcccaaactggcctgctatgaaccccagatcccatccaaatgaatccatttcttcctcctctcaggtaccatatatataaatatattatgtatttagaatattctttgtagatatgtaaattccagcagtttaatctctatcaaaagtccattttttaagggcagaaaacatgttttaacttttcagtataattccatcaagtttcgtatcttcaacgggcttaataagtactgtccataaacagtttaaacttctaaatagaaaaacaaatagaccaaagatctcccacactgaatgaaaaaaattcttctgggaccttctggcaatttctcccttcataatttccttatggaagataacaaggatgtccgtgaatcctgcagtctcatttcctaaatactggacagctaagctgccaacctacaggactcagcctttatagatctctcacttttcaatgtggcccactatgcaaaagaaatatcacccgtaagtgaaggatataagagaacgctttgggtatatggttaaaattatgaagccaacagaccaggtaaaacttagaggtcagttgtttgatactttcttttctcctaatttctaaaaccagagacaacatgtcccaatgtgagagagtcctctcatgacacgacctttaaaaaggctacaaccaggtacctcctgtctacaaggccctgagatagagttagaagaagaaacaaaatgagcaagacagttctgctcttaagaactctgtaagctaacagggagagaagtatagcaattcttagaatacaaggcaaaagtgataagtgacacaggaaagagaaagcgttgagagttcagaagaggaaaataatatagcttgtgcttttactactgtccctttcactatttctgtcataacagaaaggtcattgtaaccatctgactctctttttaagtcagggaaattaaatgcccttggaaaagactttaaaaattattggatgaaaaggctgcatctcctgggggaaagaagctggaagtatgcagaaatctactaatctatcttcaaaatatcacccatcccttcatgacatccacaaatcccacagaaagaactaatccttccccttggctcaactccacaggtccctgcttccacaccattcctttcccttcatcggcataagtttttccttttccgctggtttctcctttgccttcaaacacatatgcatctttccatcttatttcgtttaaactacttctagctctccagctatctcatttatttccttctcattgtgaaacttctctggtgaagagttctacactcattgtctccattgccttatccattgatcgttctttaacagcctgctttcttctgatattgcccaagaccatgaattgcctaagggtctttcctctgtcagtcagttaccccttctctttggcctctctcctgcacatgactgtggccacccttggtgacggaaatagcacaggatttgagtcaagacaaatatgggtaaatcaacgggatggccttaggcaaattagttcaccactgagcctctacttctttatctttcaaatgaagatatcacctagctcataggtttgttgtaaggattaaattataacttagataaagcacctgtgtctagcacacacagagtatggactttatatttgttagttaccctttcttggctaatctactatgctattctgattatcttcctgtctcacatttccatcactggctattactccttccagttatgactattccccatatctcaatctttgggcctttgttcttttttccatactcttcccagctaaagatccatccattctcatggcatcaaatatcatttctttgtagaagattctcaaatctattttctgtagacccttttcttcgacctgagcttcaaccctagtttttcaactctttcctaggcattctcacttgtacgtcccataatcaatttaaattcaacatgtggccaggcgcggtggctcacgctggtaatcccagcactttgggaggctgaggtaggtggatcacgaggtcaggagttcgagaccagcctggccaacatggtgaaaccccgtctctactaaaaatacaaaaattagccgggtgtggtgtggtgggctcctgtaatcccagctactcgggatgctgaggcaggagaattgcttgaaaccagaaggcggaggttgcagtgagccgagatcgtgccattgcactccagccgggcaacaaaagtgaaactccgtctcaattaaaaaaaaaaaaaaaattcaacatgtatgtgaaaaaaatcttcatcttatgtttttaaattaactctaattataaataagccactgattttgtaaaaaataggctaaggcattgttaaattaccatactgtaacaaatggatttttatgaaacccttcttctactaggggaaagaggagggagactcaactgtgtaaatcttcacaaaaagctctggaggtacatgaagcttataggttaggcccaaaagggctaggtatttgtcagaagtaagacatcaaggccgggcacagtggctcacgcctgtaatcccagcactttgggaggccgaggtgggtggatcactcaaggtcaggagtttgagaccagcctggccaacacggtgaaaccttgtctctactaaaaatacaaaaaaattagccaggcgtggtggcaggtgcctgtaatcttagtaattcaggaggctgaggcaggagaattgcttgaacccaggaggcagaggttgcagtgagccgagatcaccccactgcactccagcctacaggacagagtgagattccgtctcaaaagtaaagaagtaagacatcaaacatcatcactgcctcacaaatcaaatctgaaccaaatggatttcttagactggagatttaaagcaagtaagtgtggctcatgcctgtaatcccagcactttgggaggctgtggcaggcaaattgcttgagcccaggagttcaagaccagccctcggctacatagtgagatcctgtctcttttagaaaacaaataaataaataaataaaccaaatgagagactaatggtggatttgatggagcaaaacagaggaaaaaatagttttcactttggcagagttggtaacttcctttgagtaaagtaagatatacaaccccctggagcgcagtctgttaaactgtgctagcctatccaggtctagatacagggacatgcatgatttcgttttccacaggcccctacaactctctgttgtcttctatccagcctgatatacatgtttatgtaatatgactggcccctgcagatatctgattttgtaatatctggttttgagattttttaggataagagaatttgagatatgggaaactcctttgctattgggattcttagaatcagaaacccaaaatggataatttttaccccctttgtattctttctttctttttctgagacagtgtctttctcataatgtattcccacttggtttctttttttttttttttttttagagacaaggtctcgctttgtcgctcaggctggagtgcagtgatgcaatcttggctgactgcaacctcagcctccagagttcaagtgattctcctgcctcagtctcccaagtagctgggatcacaagcctgtgccaccaagcccggctaatttttgtatttttagtagagatggagtttcgccatgttagccaggctggtctcgaactcctgacctctggtgatccacccacctcagcctcccaaactgttgggattataggcgtgagccaccacacgtagcccctacttggtttctttatttgtttgtttctttgagatggagtcttgctctgttgcccaggctggagtgcagtggcacaatctcggctcactgcaacctctgcctccgagattcaagcgattctcctgcttcagcctcctgagtagctgggattacaggcacccaccattgcacccagctagttttcttatctttagtagagatggggtttcgccatgttggccaggctgatctcaaactcccgacctcaactgatctgcccgcctcagcctcccaaagtgctgggattacagacctgagccaccgcacctggccccatttgtattttctatattgatttccttttttttctctctcaaaattttaacaatttttttaaaaaattactttaaaatttttaataaatttccttttgaaaacataagcccttataagcctttgcaaaaggaaaataaagaaagaggtctttttagctcttcttgagaaaaaaaaaaaaaaaaagaagtggtaacccctggttactacaggattcacagtgagaaaaccccaaagagaaggtgaaattcagaaaaaacaaaatatagttgagaaacatgcacagccataccttcctccctggagattttcattccagagctcaaatactggtacattcatattttcagtaaggaaaacaattcttttatatgcccacggttaaaccgaccccacccatgatcttcctagtctatcaatggcatcactattcttcaaatcacataagcatatgaccaagagcctaatattcctaaagatcaccttcatatgtcaattctccagtcaaaactttcaatggcttcccactatctgcaacagtaattaataagtgcaaggagaatgtgccccatctccctcctaggagatgtgtccccacttgagaatcacagcacataatgacagtcgttaacaattgaactaaatggagaaataaatgtgttacaggcaaaaaaaaaaaaaaaaaaaaaacaaaaaaaactgaaaaccaccttcagaataaaacactaatctgccagcccaacatttaaggcccccacaatttagcctcaagttattatcttgctaactttattttctactaatcctcatccattcttattcttattttccatcctttgcccaagtgcttcccacctaaaatgtcttccacatagttttcaatcaaagcctaaatcaaagcccagttcacgtcctgccatttatagaaagctttttctaatcactccactactatggcccttattatcattcactaagcactataagctctttgatggcaatattatcataccttatatgctcacagaacctcattcagcccgcatgcacctgaccgaataccgaaaggatgaattaactgcaagtttttctaggtcggagaactgacacacataataggagggagcatattctcatgcatctagacttatccttttttacgatgcccacatggacactaaaaaaaaaccaccctgaatcctatggctttctctacatattgaacaacaggtacatggtaaaagggtagcccttctaactgtggaagtggagcccttgtgactctaagactaattttctttccaggattttgttaggtacttattcttttgacttttgaggtgttagtctcttaactggctctaaaaaaagagaggttctgggatttctcaataataaaagattcaaggtttatatacacttcatcccgaagttgggactgcctttcagaaaacataaatgtcaaacaaataaggcaggtggtagaatgggaatataggctactcatctatttacatgtaaggctgcctatgtctaaggctaccaataggtgattatttgctggcctattcataagaggaggaaaataaaaaagagtgggaagatatgatttcttcttctattcaacaaacacttatagagtgcctactatgtgtggaggcactgttctaggcacttgggctagaccagtgcacaaaacatacatctttgtccttgttgagcttacattctaacagacaggagatagaccataaacagtaagtataataaaataagtaaattttatggcaatatgttggaaactaggtgctatagaaaaaataaaaagtagaggatggtaagatgaaatgggagtgctaaggtgcaggggggacaaatggagcttacaactttaaatgagtagtcagggtaaactctattgggaaggtaacatttgaaaaaagacattgttgtagtccatgtagatggatgtagtctatgtagatatgtctccaaattctttgacacagctccccttaagaggtgaagtttaattaattaccttccacttaagtgtgacccagacttagtgactcatttctaataaaaagaatacagtgagatagtgatagaatgtaacttctgaaattaggttataaaaggactgcaggtccatttggtcttggtttcgtttctcattttcttttctttttcttttttttttgagacagagtctcattctgttgcccaggctggagtgcagtggtgtgatctcagctcactgcaacctctgcctcccgggttcaagcaattctcccacctcagcctcctgagtagctgggattacaggtgcatgccaccatgtccagctaatttttgtatttttagtagagacgaagtttcaccatgttggccaggctggtcttgaactcttaacctcaggtgatctgcccgcctcagcctccaaaagtgctgggattacaggcatgagccaccccacctggccttggtctttgtctcttggatcactggctctggaggaaaccaggtcctgtgagtagccctatggacaggccacatagcaagaaatggcacctcctgccaacagccacatgagaaagcttggatatgaattatccggatgttacaatgactgcgttaccagctgacatattgactgcaacatcatgagagacactgagccagaatcacacccactaagctgctcccagattcctgaccctcagaaaccatgcaagataataaatgtgtttttggttttttggggttttttgtttttgtttttgttttctgagacagagtctcgctctttcgcccagactggagtgcagtggcacgatctcggctcactgcaagctctgagacctcccaggttcacgccattctcccgcctcagcctcccaagtagctaggactacaggcgcctgccaccacacccggctaattttttgtatttttattagagacagggtttcaccgtgttagccaggatggtcttgatttcctgacctcatgatccatctgccttggcctcccaaagtgctgcgattacaggcgtaagccaccgcacccagcctgttattttaagccattaaattttgggacaatttgttacacagcaatggataactaatacagactttaaggaagtgaggaagttggccacacaaatatctgaagaaagaacattccaggcagagggaacagccaatgtaaaggcctaaaggcagtgttagagtgttagaaaaacacttaagagtgttagaaaaacagcaagaggccagtgtggctgcagtggagtgaatgagggaggaagttgtaggagatgaggtcagaaaggtaagagagttctataagatcatatagggttttataggccatggtaaagtctttggattttactctataaatgaagtgttaagccagtgaagggctttgagcagaagaatatcacgatgtgccttgcaacttaataagatagctttgttgataataggccaggagggggtaggagtagctgcaggatacaaataaggaggcttttgccataatgcaggtaggagatgatggtggctccagtatggtagcagcagaggtgagattacgggcatagttttaaggtaaagccaacaggatttcctgatggactttggctgtaggaagtgagaggacagcagtcaggatgactccaaggttttttcacccaactaaaagtgaaagaatgaaccttccatcaacttagatgggagggggttgttggaaaagtaaatctgggcatacgactggaagttcaattttggacgtgttgaatttaagatattttttaaacttcttcatgaaaatgttaaacaagcagtctggagtttcagggtaagacctacagtgaagaataaatgtgagattcatccacaaggtggtatttaaagatgttatagtggaatgccagaggagcaggctgaagatgtcaaaaggatcaaatcataaatgatcacgtgtggcgtgcaaggagtttgaactttatcctgtaggaaaccgggagccactaaaggactctgagcaaaaagtgtcataatcaagtttcagtttcaaagacatcactctgacaaaactacaaattcaactgcaggggaataagaactgaccaggagacaagttaggaggctgttgcatggtcaagccaaaaaagggacagaaaggccaggaacagtggctcacacctgtaatcccaaaactttgggaggccaaggcaggtggatcacctgaggtcaggagttcaagaccagcctggccaacatggtgaaactccatctctacaaaaaatacaaaaattagctgggcgtggtggctcaagcctgtagtcccagctactcaggaggctggggcatgagaatctcttgaacccaggaggcagaggttacagtgagccgagattgtgccactgcactctagcctgggcaacagagtgagacttggtctcaaaaaaaaaaagcagggggggagtgggggaaaagggagagaaaaatggctaatttcagacaacgggaggtagaatagagaagataggcagattcaaaagacggtcaataaattaggctttgaaagtaaggacaaagaggaaagtgagtgactcccaaatttctagcttagaaaactgaatggatgatggtataattccccaagataaggaatataagagaaatagtctgggggagtagataattcattttggacatgtttaggatgtgctttatgtgggacatccaggtggaaatgccaaacatgcagaaagaaatatgggcctaaaacacagtggagatataaaattggtattcagcgatgtaccaacaatagttgacactggggtctagatgagatgacccagaggaaggaaagtgaagtctcagaggatcagggacctgatcctgggaaacactaacctttaagaggcaggcagaagacggagagccagccaaagaaaccaattagaagtgtgaacaagcttaacaagatggcaattttcaagttaaagcattgcccatcttccccaggcgatataagctctagcttcgtaagagcagcagtgactctcttcatagtttaaagtatctgctctagaatcaggctgcaaccagacaggagctgaagacagtaactaaaactaggcagaatataacaaccatggctgcacttaggatgctaagtcaaatcaatgttaactatagccccctaatttcttagctaaggtattatactgaacagattaagacttataaggcattcagaatgcagcagtaagaacgactgcagggaagagaagagaagagaagaggagagaagagtagagaattgcaaaatctccatctctgctaagggacccctaccaaaggaagccaacttcaagcaactgcccaggttttggtgtcaagggctgattcctagccaggggttgccagctgtagagggcggggctctattttgggctgcctgctgtccctgagcctggccgcgtctggtttgagcagcatgcagccccagtgactcacacacccatgcaaactgcctgtggctcagtggcatggccttggaatgccagccttaggccagctccctcctcaccccattacactgggataaataaataaagagcccgccagcagccacacagcctgatggcaaccagatggagagagcgaggcatggacagggccaggggaaggaactccctccagtggactagactgagagtgggctctgcccagtcatcctaaacttcctttttcatatagttcctactgccgtgtaacaacagtccctaagtccctgactcttctttcactcctaaagatgcctctcaacccccagtcctacaaaatgccctatatagggttcttggcctccatgaagatcatgccaacaggcatcccacccaggcttgacttgagtcaatattgtcagtatcaccctctagttaggccactatcaactggctccttgggttccccagaattgagaaatcagaggctcttagacagagtggaaaaacaaaaggaccaaatagggagaagtaacccctgttcaattcttattttcccgagccttagtatcctagccacctgcctggcctactgtcccctgtgccttattgtctatagcctcttgcctagtaataatcccaatgagaattttaaaaactgaccccaggcaatgaccgcatggccctctgacaccagccctggcccccctgcgccttcatcttgagctctctccctggtttgtttatcttcctattccatcttgcttattttgatggcacatcctttcagttcagtcttgggtgaccccatgacccttctgtgtcctgtttgtaggaccccgggcaagcagagtaactaaaaagatgcagtagtcataagaagttctacagccccagtaggaaacctttcagttccagcagctatacaggacattctgaggacagtgcaatgaccccagaggtcacaagaattccatattaccccagcccttatgtctcccctaacaggtgtgtacaaccagttaaactagcaaaacaaaacagggataatcctagactatgtgtcaagaaatgtgagaagtcctaaacataaagctacagctatatgaccttaggcaagtcacttaacctctctgaggctcaacttcttcatctataaaatagaaagctgtaactacaactacctatctctcacttcctttccagatataataaaattctacaagtctatgaggttgatccacccagaacctacaggaccagtattcttgaagtagctggttccaaaacactgatactcttcctgtgctgccacctaaattctgtatgctttctcattcaattccgcagggctcctcccaaccccatagtatgaaaacgatgagcctctaattttataaatgagaagtgatttatccaaagctgcaaaatgagccatgagaataactgaagaccccaaatataggtctaataagcaacactgagccaggtgcagtggctcacgcctgtaatctcagcactttgaaaggccaaggtgggcggaccacatgaggccaggcattcaaaaccagcctggccaacatggtaaaaccctgtctctactaaaactacaaaaattagccaggtgtggtggtgcatacctgtaatcccagctactcaggaggctgaggcacaagaatctcttgaacccgggaggcagagattacagtgagccgagatcaccccactgcactccagccaaaaaaaagcaacactgtatccacaggccacagtgtcataatctgtataaaatccccctagcatagacttatcaaaatattaatccaaacttattgaagacttactacctgtaggcaccacgcacagtgctggggatatagaaatgcattcagcatggtccttgcctcaaagagtccacagatcagtggaggagaaagccatagtcttgcaggcatacaaacagtaatattacaatgttataagtggtaaaacagaggtataatccaaggtactatagtagcagggaagaagaatagtctttacaagcagagtacagaacggtctcccaaacaaggtgaagctgacatctagaagattaatagaagtttgcaagttagataaggccagaacattggacattctagatcatgggaagaatgtgtatctaaagacaagatgaaacagcattggggcaaattaaaagtcattccatatagctaaggcataaagtacacagagaaaaatgtcaagaagtcaagctggagaggtatgcaggcactagatcaggaagagacctctctactgagctaagaacaagccttgcattgtttaactaaggggatgaggcagggaaccagcatgttatccccagccttgatacctaaacttatagacaggggaagctatctaagagaaaaacggcctaagaaatctctcttagtcacaagtttaggtttaacggtctctctttacccataaaaacttgaaaccttttctaggctaggcatggtggctcacatctataatcccagtactttgggaggtcaaggagggtggatcacttgaggccaggagttcaagaccagcctgatcaacatggcgaaaccccgtttctactaaaaatacaaaaattagctgggtgtggtggtgcgcacctgtaatcccagctacttggaaggctgaggcaggagaattgcttgaacctgggaaagggatgttgcagtgagccaagattgtgccatggcactccagtctgggtgacagagcaagtgaggcttcgtttcaaaaacaacaacaacaacaacaacaacaacaaaaagacttgaaaccttttctctttcaggacttagcaatacaagttttccttcttcttcagacttacaattgcttcagtacctggactgagcacctacctcacattttttgcttttagtgtttagaccccaagcattgtagctcagtcaatgcacagaggcagaacaggaggttccaaataaagaatacctgctttatgcctagccctttaaaaagtgctaatttagggttcaaaagaggtacgggacacagaccctgtccacaaagagcttacaaattaatctagaagacaataaagaaatacaaataatctatacataataccagattataatagcattatttacttacatgataaagtaccaacttgggtaacatatataattagaaaatggggcaataggccgggcgcagtggctcacacttgtaatcccagcactttgggaggccgaggtgggtggtcacctgaggtcgggagttccagaccagcctgaccaacatggagaaatcccatctctactaaaaatacaaaattagctgggtgtggtggcacatgcctgtaatcccagctactcaggaggttgaggcaggataatcgcttgaacccgggaggcggaggttgctgtgagccgagatcgcaccattgcactccagcctggacaacaagagtgaaactccatctcaaaaaaaaataaaaaaaaaaaaaagaaaatggggcaataatactaaggtactaactgtacaaccaacaagtcacagaagagggagggaaggagaagatcaatattgactggcattatcaaaggtcactattattaatactttccctatttggcatttaatagatgtttcttttggctgagctcaatccttagaagggaaacctaggcaggagcttctgacaggccacaattatctactccccattcattcctttgccagtccccttgtataaacactgtgattttccacaacctactgtgcccacaagacagcccccaaatggtagccctaagctttttaccttcctctcctgcaggatcctgaaagggcctagacaagtaatgacgcctacccttctcctccacagtccagaccttacgaccagatctcaacaagcaaaaatttaataactggtcaaccaacctttccaaggttagagaattccaaatgaaatccctggtactttaacagagatgttttataaatatcaatcagtccacttccgcctcttacgttctttccccgttttttccctcatcttccctaagtacatctcaagccttatcagactttctatgggcaactttttcagacaaagggcattccaaccacacaagccacctaacacccaaaacacaaatggccactcaggcacctggaaagaggaagtagggcaaagacacacaagaaaatgacaaataccttacctctatcataaattgttccaagaaggaattttcttcaaatggttctgtcttcaatcgatctgtaataagaaggatcagaaaaaagaaatatgagtcatacaggatgagtttcttacctgatggaaagggaacagaacagggctacttaggaaagaggaggaaggtgcatcatgcagagacacctagttcagtgggagaagaagggctgagagcatgtgggcaaaaagtagtgggagagggtgattagcaataaatggcaggtttggtggcagcatctgctctaggagtttttcctgccacaaaaacaaaggccaaattgaatttttattctgaagttggagccatgaagcttcctaaactcccaagtccatgttgctctggtacaattctgtatagctattggctcctttccaaagtctttccctgccattgcctagggcatgtctggactcggttacagcttctattggccacttgggctccagccaggtactcgaggcagagaaaagtgtcacctaggccaggcacggtggctcacgcctgtaatcccagcactttgggaggccaaggcaggcagatcacttgaggtcaggagttcgagaccagcctgaccaacatggtgaaaccccgtctatattaaaaatacaaaaaaattagccaggcatggtggcgtgcgtctacaatcccagctactcgggaggctgaggcaggagactcgcttgagcccacgaggcggaagttgcagtgagctgagatcataccactacactccagcctagctgacagagcgagactccgtctccaaaacaaacaaacaaaaaagagtcacctaatatcaagactccagtttctggttagtattcagcacccatcctgggggaggcacttctctaatgcaaatgagtctccctctttgctaagaccctttgactatttttaacacgccccacccaactcctccaagaatgtcctcttacctcgaatcagcgtagccccactctcctggtagtcttggatctctaggtctttcatatgaagtaacgttgctagctccctcacttggcactgtaatgccagactcatgcccatcagaggacgaatcaaatgttgggagacctttgagggaagagatatcaattagccaaaagactcttataaagtactttccaattcagtattaggtaccagaaaaaataccgaaaaataaatgttcttacagaaacttatagtttcataggcaagtaacccatttacatgaatgtaaacacaaatacaataattaaatatattaagaaggtggctggtgcagtggctaacgtctgtaatcccaacactttggaaggccagggcgggtgggtcacttgaggtcaggagtttgacacaagcacggccaacatggccaaaccctatctctactaaaaatacaaaaattaactgggcttggtggcagaagcttgtaatcccagccactcgagaggctgaggcacaagaattgtttgaacccaggaggcagaggttgcagtgagccaagattgcaccactgcattctagcctgggtgacagagtgagactctttctcaaaaacaagatcccaccagctgagatggctcatgcctgtaatcccagcactctgggaggccgaggtaggaactcacttaagcccaggagttcaagagcagcctgacaaacatagtgagaccccatctctaccaaaaaaaaattttttaacattagccaggcacagtagcatgcatctgtaatcccaactactcgggaggctgaggtggaaggatcacttgagccaaggaggtcaaggcttcagtgagctgtgatcatgccactgcattccagcctgggcaacagagcaagactgcatctcaaaacaacaagaagaaaacaaacaaacaaatgagaaaagctgaagatccaagtagccctcaagaaaataagtgtggcaaaaacagagtacactagctaaagtgtaacagaagacaaaaatcaacagaaggtaaagacccttgaagatcaaattagatccagacactaagagccatttcagggctcatgatagcccagaaggaccctggagtttcaatctgttcccacaaatgcagcatagtctaaggttattgttataatagaagcaagccagctaccaagaactagcctaggaaggtataagccaacgcactctacacacaacccccccttttttttttttgagaaggagtttcgctcatgttgcccaggctacagtacagtagcacgatctcagctcactacaacctccacctcccaggttcaagcgattctcctgcctcaccctcccgagtagctgagattacaggcatgcaccacgatgcccggctaatttttgtatttttagtagagacggggtttcaccatgttggtcaggctggtcttgaactcctgacctcaggtgatctgcctgcctcggcctcccaaagtgctgggattacaggcgtgagccaccgtgcccagcccacacaccccatttttaacaagaggtaagaagaatgcaaacgcagccatactgccgtacaaatagggtgatactctcatatgataatgtatagctatatagaataatcatttaattcacctacacaaggtgtccattaacctgtcaaaaaaaataactaggccggctcatgcctgtaatcccagcattttgggaggccaacgttggaggattgcttgagtccaagagttcgagtccagcctgggaaacgtgatgaaacccagtctctacaaaaaatacaaaaattagccaggcatggtggcacatgcctgtaatcccagctactcgggagactgaggcacaagaatcgcttgaatccgggaggcagaggttgcggtgagccaagatcatgccattacactccagcctgggtgacagaacaagatcctgtctcaaaataaaataaaataaaataattcaaattaataatctatctgtgactaagggaagttatcagacttcctttccctttccttaaggagatgaactaaagaaggcactaaaaagaagaaatgccctagatcagaggtcagcaaactttttctataaagggccagatagttaacatttttggctttgtggcctatccagtccctgttgcaactactggactctcctgttgtagcacaaaagcagccacagacaatatgtaaacaaatcaagtggctgtgttccaaccgagctttacaaaaacaggcagcaagccagaattggcccatggccatagtatgccaacccctgtcctagacctgaaaaaggagtacttttagacaagataccccaacaggcttgaaatgaggaaaaggtactagagtatcccataacatgtgcaagccagactcatctggatccagattagacgtctggactctttcagacctttgtgttttcattttccattcattttctaggtaaaatttactactaaaagttctaattgtgctttggctcaaattaagaggaaaagacttttttccacatttctgctagattagaaaagactggatgtggggaggtgggaagaaaggaagttagtggcggcagcttttgtaccaaaaccaaggactaagaaatggaagggttctggcacagaggggaaagccagaaataaagtccagctatagatactagagtcttccttctaccacacagcacatcccaacctggcactgactcccaattgaggtccttagcaaaaacttaaccctctaggaagtactgttcagaatgtggcagaagttcagctttggaaaaatttatctgctctacactcgatcttctttcctaggaattgttttgttaaatttggtcctgctgggcgggcatggtggctcacgcctataatcccagcattttgggaggccaaggcaggcggatcgcttgagcttaggagtttgagaccagcctgggcaacatggtgaaacctcatctctactaaaaatacaaaaaattggccggacgcagtggctcacacctgtaatcccagcactgtgggaggccgaggcaagtggatcacctgaggtcaggagttcaagatcagcctggccaacacggtgaaaccccgtctctactaaaaatacaaaaattagctgggcatggtggcgggtgcctgtaattccagctactcgggaggctgagacagaagaatcgcctgaacccaggaggcggagggtgcagtgagccgagactgcgccattgcactccagcctgggtaacagggtgagactccatctcaaaaaaaaacagaaaaaaaaaaattagccaggtgtgctaaagcatgcctatattttcagctacttgggaggctgaggtgggagaactgcttgagcccaggaggtggacgttgcagtgggctgagattgcaccactacactccagactaggtgacagagtgagaccttatctcaaaaaaaaaaaaaaaaaaaaaaagtttggtactgtttaaggtagatcaggaggaaaacaggcaaatacttgtataaatgacagtgaatatttgatgagttgaattgaaataattgtcattactacccaagcagcaacaccatccaattggcggcagcactgaaacaacagaaactcctaaattaataaccagcttccctctggatggctacctcaatagcaatttcctcgagtgacagtaaatattgtataaaaacatgaaacatgacaaggaacagcttttaattaatgtcatgtctaattaaatatgataatgccacatcaggcaactgaaattatctatcagaccccaatgtctatttggtttaaagaaagtttttttatcagtaaatattgtaactgctaaaataatttcataggattgggttacagcattttgaattattgaggtataattcatttcaaagttagatgaacaccaaaatgatttctcttagaccagatagccttaaattaatgctcagtagaaattttgaaaatatgtgttaatgggcatatgagagactagataaaatgtgtaaaaaagtcccagcactttgggaagctgaggtgggcagatgacccgaagccaggaatgcaagatcagcctggccaacatggtgaaaccctgtctctactaaaaacacaaaaaattagccggacatggtggcacgcacctgtagtcccagctactcaggagactgaggcacaagaatcacttgaacctgagaagcagaggctgcagtgagccgagatcatgccactgcactccagcctgggtgacagagagagactccatctcaaataacaataataataataataatgtgtaaatagttcaaagcaaatccacagacactataaggaaaaatcttgaagggctttaggatgtcagggacactccccgtaatttatagacagcaatatatgaagatatacagttcatcagtcaattcaacagatatctactgggttcctaatatgtactctgaccctatgaggcctctgccatcaaagagcttacaacagttaaggaggttaggaagtgtaatagatatacaaacaggagttgctaatctttttccgaggaaaagctatttataattttctccaaagtcttcagattttccacagaaatgttcataagtcatgagcaggggagcagaatgataggtctcaatctcaagatgaatcaagctggaggctaaagcgggagaatcacttaggcccaggagttcaagatcagcctgggcaacatagtaagacccccatctcataaacaaacaaacaaataaacaaaaaagatcaagatgaatcatatcaggagatccagtgaaggctggagcacagtagcacaatcacagcttactgcagccttgaactcctgggctcaagtgattctcccacttcagccttccaagtagctaggactacaggcacatgccaccacacccacctattttttttatttttttatttttttgtagctatgggtttcactgtgttgcccaggctggtcccaaactcctggtctcaagcaatcctcctgtcttgacctcccaaactggtgggactacaggcatgagccatcatccccgggatctctttcatttatttatttatttttatttatttatttatttatttatttatttattttgagagagtctcgctgtagccaggctggagtgcaatggcgcaatctcagctcactgcaacctccacctcccgggttcaagcaattctcttacctcagcctcctgagcagctgagattacaggcatgcaccaccatgcccggctaatttttgtatttttagtagagatagggtttcgctatgttggccaggctggtctcgaactcctgacctcaggtgatccgcccgcctcggcctcccaaagtgttaggattacaggtgtgagccactgtgcctggccccagcatctcttttaaaacgaaaagttatggagttgaaatatttgccctcacaggtccactataatgctaaacataagtaatattacatatgttcttttatttaatccttacgactagacagtaaggttgtggttgatttattttacagatgaagaaactgaatcataaaaattcagtacttatccaaattaatacaagtagtctcaaagaggtggagttgagttacaaattcgagtctgctggttccaaaacctatctctttcttacactaagaaacctttggatatagctcctaggaatcataaaatgtccaaagatatcacaaatctgaaagctaaaatgtggaatatcaagaattatattagatattagaaagaacagacaacaggaaagagtaagagatgaagtctgtcctaaatgaagatggactcagtgttagaacccagagacctggggccaagcacggaggcttacgcctataattccaactctttgggaagccaaagtgagaggatcacttgagctgaggaattcaagaccaacctgggcactatgatgagacttcatctcaaaagaaaaagaaagaaaagggggggggggtggagagagagagagagagcaagcaagcaaacagagacccaaaacccaatatattccataatacccttgcagacttagaaaccattagcttgttaatgtgagtatgttatgctggagaagtatgaggaacaggtattctcctctttcctgtacagctggaaggagttaagctgcataatgtctctgaaagacaatttggcattatgttatgtggcaagattaaaagatacaaatattccttgacccagccattccacttatgggaatttactcacacatttacatgcaggaaaagtaaatacaaggatagtaactgtatacaacaacaaaagacttaggtgtctactgacagcagatcaattaaatatatgatacattcattaaatacaatgctatgttgcaattaaaaaacacaaaggcaggtcctctgaatgtgttgatatgaataatctctaagttcttttttttaaggctcatcaagtgaagcagtgggtaagttctacaattaagtgaaaaaaggaaggtactaaacagtgcgtacagcatgatactatttgtcaaaaaatacacatatacatagatatatatttggtcgtatgaagatatatatacagtatatacatatatagctttaagaattcacaagaagctgatattggtagttgctttgcaaaaggaaaaggagggactagggaacggggtagaaagatctattttttcactgtatacacttaaatgctgtttgaaatgtttgcctttttcaagaattactcattcaaaaaaattaaatgaaaacgatcacaagaatgagttacaaacaaaaattatgactgtgtgaccttacagacatacacacaagcctgaaatagtatccacctacatccttacccgtgtccactggctctaactttttccatataaagctctctcaggttcaggcgtttccctaggagggcattcttcttttaatgatgagtattttattttaacttaaagcacaattgttcatgaattgctcaaatctaatttcttcctatggcaaaccaagactcatcccttcctaaacactgttgtctctttcctttaatgtagttccccaattagagaaatttgcctagaatagctagtttttctttacatacttttatattatattgtattatatatattatataatatataatacattatattataccattacatattatattaatatagattaatataacatataatatatgttaatatattatatattattatattacatatatttatatattaatctataatatagatatactatataattgtaatatcattatattagtgttccttactgtattcttttgaaagaagaaactattagagcccatcagcctccaaggagaactgtctccacaatcacactacatattccgcatttctaggtccatgtaatgcaaaatgagattagctattgctagggattcccaaaggccgcccaaatggtttggtcccagaacaaacattattgaggaaacactgccccctggtgttacttagaaagttgaaatgttttaaacgaaataaagtatgggatggggccaggctcctgcttgtaatcccaacaccttgggaggccaaggcaggaggattgcttgaggtgaggaattcgagaccaccctggtcaacacagagagaccccccatctctacaaaaaattttttttaattttatttatttttttaattttattttttaaatttattaaattttatttatgtatttttatttgcaagatggaaaagttcacaagaaattaatttaaaataaacaaatgtgagtatatgctaagtactgttgatagaccttagaagttaataaatgaataagtaattctctcagcactcagttctagttttactgggctccagatcaaaaataaacatcagggccgggcgcagtggctcacgcctctaatcccagcactttgggaggccgaggtgagcggatcacgaggtcaggaaatcgagaccatcctggctaacacgatgaaaccctgtctctactaaaaaatacaacaaaaattagccgggcgtggtggtgtgcgcctgtagtcccagctacggggggcgctgaggcaggagaatggcatgaacccaggaggcggagcttgtagtgagctgagatcacgccactgcactccagcctgggcgagagcgagactccgtctcaaaaaaaaacaaaaaaaaataaaattaaaataaaaataagcatcaggccgggtgcggtggctcacacctgtaatcccagcactttgggaggccgaggtgggtggatcacgaggtcaggagatcgagaccatcctggctaacacagtgaaacctgtctctactaaaaaatagaaaaaattagccgggcatggtggcaggcacctgtagtctcagctactcaggaggctgaggcaggagagtggcatgaacccgggaggcggagcttgcagtgagctgagatcacaccactgcactcaaacctgggcgacagagtgaaactccgtctcaaaaaaaataaataaaataaaataaaataaacatcagcaaacaatttctcaagaagtctttctatccagtcatctattgatgccaaagcatcacatcccctgtgggaaactaaagaagagagaaaaaaatgatgtcctcttgtcttcagatccctctgctaacaatctatacttttaggcttcccaaagaagaccctgtcccctaagtgctactgactaaaactgtgtctgttattccagaaaactagtctttaacgtccactcttaatttctaataaaatctcctgggaaatataaagctatgagtgagtagaggatattatccccctagtctctgaaaatgaggctttggaccagactaatctgggattcaaattccaactcatttattcataagctgatggctttggacaagttattttcaatctcagtattctactctgaaaaacaaggataacagtacttatcctgaaggagagttgtgaggattaaatgatgagataatgtttagaaaggtatctaacactggtacatattctattctgttgccagaataatcttgataaaccacgaattggatcatgttaaattcctgtttaaagtttttcagtgaatcctgttgcctttgagataaaatccaaactcattagaatccttcaagatccactgcctccctcatttctcatgccttcctatctacacagcagtcatgaagttcccgaacttgctcctcacttacacatctctacatctcttgcctacaatgatttttctatttattttctcctactcatcttcaaaacttagctcagtaacagtctcttcaaagaggttttctccaatcctcaaccatccagggtctacctcaaagaacctatcatactttatcataatttcctgtttgtctgtcttctcactagattatgaactccaggaagaggctatattgttttaggtctggataaccaacaattagcccattgtagatgcttttaaaatgctgaataaattaattaatgaataaagacactcagtactctgctccttttgcaaggaaaggatttaacagtcaagaatcctttttgccttctgtttagtcaaggaaagttttctgattggagaagaatttcaaacaaggtttgcaaaaaaaataaaagcacctaaagcttcctctcaaagcaactggcatccctcccccaaccccacattcgaattacacttaccagggaaggactagctagcatgcagtggaaattccaatagaaggggaggccagagagctcacttcgcacccgtagaatcagtgcatctgccacacaatcacaggagaaggtagcttcgctagggtgagcagcgtccttcaacaatgggcgaaggagattatccaaatgacagaggaaagctgcaggaggagcagtgagccgcttgttcagctcctaaagagagagcagtggtacagagtaagggtgctaaaaggaaactaattccctcataagtaacagcaaaggaaagccctggttaacacgaaggcaatggacatgagaggaaggggagagaagataaaaacatcacaaggggaaagaagaaaacaaaaagaagagagtcacaaagaccaattggcctacttcacaattctgccttgggcaagattaaatcacaaaaggcctatctagatcaaataatatattcattatcatgcatagggtagggaaactaactttctttctctctctctctctctctcacacacacacacacacacacacacacacacacacacacacacacacaaagattccaggcagaagtacaggtagaagtacaggacattaactggaattgtctcaacccgattcaaccttccttgggaaactacaggccagcaagctggttgatgttcacatccccgacacagcagtacttctcctcatacttaccttggctcgctggctgaccacactagtgtccacctgttcatgccacacctgttgaagatctgaaaccaacaaggcatagccctgcttggtgataaaaaccttggccaagagggagttctctgcaagctgtagccacgcccatggctgcatcaacaggccttgctccagttcttccatctgcaaaaaagtcctcatttagtaaagagcctcagggtcatgctggcctagggagggcaccacccaaaccagtctgtatcaactaaaatctcatgaaaatcctccctgataaaatagaaggcatggatttacgttctcccagtatacaaccagctgagcactgactttactacctcctggccactaaaagtatatttaaaatcttgagggttttttttttcccatattacattcctagaggacagaaaatctttcttccatagtgtttaaacctcagcatattgctgttagtatttctgctttctaatactataacataacgtggaaacctaaacccttcttgttccatctttatcacattcctaataaatatgtcactcctatcctttcccagaactagaagagaaggaatagttcttgtcttataaaacatcataagtcatagtgtcagggccaggaaattcgaagtatttgatcattatctaaaaacaaagtttaggaagctctcaggatttttttaaaaatccctaaaacaggttcttaatctagagtcaatgcatgtgaatcctctagaattatatgaaaatgttatgtgtacacgcatatatgcatggggagggggaagaggtctacagctatcatcaaactctcagggatcgatgacacaaaaaagagctaagaacctgtgtccaggagcaacagaaaagacctaaatttcatttcaacaaaaaccagaatgactaggaaatcatgaatacaaggcagagcacatcacagaggtaaagactgaattaacttccacttaactcatcctccacattcccactccagtgcactgccaccaatgacaacatgcccagcctggaacccctgcaaaacaacttttctatctcagcagctaaagtagtaggcttaacctagtagacaatcagaactacggctgcttgacagagaatgtgattgtttttcctgtgggggagaaaaaaatatgtcaatttccttcattattccagtctacaaatataaaatgaacagaagtaccaggaaggaaaaatttagaatgtaaataatgaaattccttattaagtctgattaacacagtcatttcccctagcttttgaagtgtgcccttgtgacttgtgacataactttatatatatatgcatatatatatgcatatatatatatgcatatatatatgcatatatatatgcatatatatatgcatatatatatatgcatatatatacatatacgtggtgatctttctttatggcatcctcaaagccttgtgtttggaggatggtgtttccgtcacatttcccacatgctgctcttatggggacagaagtggtcatgggatgattaagctagtcctagccggacaagagctccacaatgccaaaggtcacaaacgcgaataaagtcgccactttcatctcccttataggcactccccagtgtactcttaacagttgccaaaattgggtttactattctagcccattccttcggaaagcccggaagctcagaaccctcaaattgatgggttttgtttgtctgttgggtaaagggggaggagtttaaaatgtggccaggagtaacgggccctataaaaaggcctgacacattgggcaccagaccccggctgcctgctcccaccacacgcgtcccgttctgcgtccgaagcttctacacttcatccttttcttttttccttcaaggctgcctctaacattcacattaacgagattcacgggtttatttctcttgagtggaggggcgctgagcggcatcccggcggaggggtcccttgagaacctttatctgcaccgagtccgctcctcagcagtgacccctctgggcagttcctccgacgccctgcagagggcagtagaggcccagagagcatcccggctgggccccgcccggtccccctgggacagcgcgaaccctaggtcccaccacaaccatagccccaccccaggagccgccaggcgtcccgcttccacccgccccagctataacagccttcgctgtccgccttcccatttctacagcactggctgcactggggcgcggcttcaaggggcaacaaagccggccaccagcggcttcgtcgcaccaaacaggcgaccaacgagtaccttcactcgagccctaccatccacgccgggcagcagccagcggactgcgcacgcgcggccccgcccacccctcccccggaggcctgccctggaccccggcagcgcgcgctccctccagggagaaaaggccagcgccagggccaacccgcagcgtctgagcagcccctcgctggcttgctcctgcccggactcgaacgcgattccacctaccgtcagcggccgcgagagcgcccactctcttagccgcacgcacgctttcctgcccgctcgcgcaaaccgaaaggcctagagtaagaggccgctttccccccaccgcaagaggaggcagggtcttgggatacaggggcggggcctat

SEQ ID NO: 1892 - DNA, 31056 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggtgagtggaaggaagacttttaaaaaaaattgtggccaagtgcacatagtgtacaattttccatctttatatatatatatatatatatttttttttgagacggagttgctcttgttgcccaggctggagtgcaatggtgagatcttggctcactgcaacctccacctcccgggttcaagcgattttcctgcctcagcctcccaagtagctgggattacaggcattgcacctccacgcccggctaattttgtatttttagtagagatggggtttctccatgttggtcaggttggtctcaaactcccgacctcaggtgatccacccgcctcggcctcgcaaagtgctggaattacaggtgtgagccaccgcgcccggccgtaataatttttaaatgtacagttcagtagtgttaggtacactcacattgtgcaaccagtctccagaactgttttcatcttgcaaaactgaaactcctcacccattgaatgataactcctcattgcctcattctcccagccctggtaaccaccattctatttgccatctctgtgaatcttactactctgggtacctcatataagtggaaacatacagcattttttcctttatgagtagtttatttcactcagcataatgtcctccgggttcaactatgttgtagcatgtgtcggaattcccttcctttaaaaaagactgtataaatactccatggtaccatataccaaattttgtttagttatctgttgatgaacacctggattacttctacctttttgttattgttaatgctgttatgagtgttggtgcacaaatatctcttcaagaccctgctttgaattctctggggtatatactcagaagtgaaatttctgaatcatacggtaattctgttaaatattttgaagaactgctctactgttttagataccatctgcaccatttcccaccaacagcacacaagggttccaatttctccatatcctaagaacacgttatttttatttattttttcttttttatagtagccattctaatgagtgtgaggtggtatctcactgtagttttgatttccgtttccctaatgataagtgatgctgagcacattttcactgcttgttggccatttatagagcttcttcagagaaagttctgttcaagttcttttctcattttcagaccaggtttggcttttgttgttgccttgtaggagttctttatgtattctagatattaaccccatatcagatatatgatttacaaatattttctcctattctgtgggttgtcttttcatttggttaactgtgtcctttgatgcacagaagttagtatgatttttttttttttaaatcatggccgggcatggtggctcatgcctgtaattccagcactttgtgaggctgaggtgggtggatcacctgaggtcaggagttcaacaccagcctggccaacatggcaaaaccccatctctactaaaaatacaaaaaaaattagccgggtgtggtggtgggcacctgtaatcccagctactcaggaggctgaggtaggagaattgcttgaacatggggagtggaggttgcagtgagctgagattgcaccacggcactccagcctgggctaaagagcaagaccctgtttcaaaaaaaaatttttttttcttgtattgtcttggttttttctcttttcccctctcacggtagtgctatgagaaggtggaggcaaactgtttgctttctctaactcctttaaaaagctgatgcagactgtacctaccccctgggcacctgccatgattagtccctctttatctgaatctcagcagtgcctagacctgcctccaattctccatccagcttctcagaccacatgttttgtccagtatctgctgtgtggtcagcaggcttgggcctctgcttcctatggcccagagggcagcctctctccttgaagaaccgtggagtttggggcagaagcctttcctttcaccaccactttgggaattggaatgtaaaagaaattctcttaatccccatgtacacattggggataaggttctttcttttgtcttgtgttctaggcaaaggtagggctcagagaagggcagggtattgcaggatgatgatgtagagctggtggtgatgggaaggaggagtacaaatgagtcagtggatagggagacacatgttaaggcagggcagcagtgtgggtgtaatgacactggggaaacagacagcagtgtgcagccgggggaggtcagaaaccagttgctgcaatggctctcacctgtagtcccagctactcaggaggctaaggcaggaggatcgcttgagcccaggagctcaaaaccagcctgagcaacatagggagacctcatctctaagtaaataaagcaattatcattgtgtcagtacttatatactcacatacccaaatgaaagtgtcataatcacaactgtagaagtactttgctaagcagtttttatggattttatggcacattcaagaaacccatgaaacagcttctggtattatccctcctgcaagtgaatgaggtgagcctggaagagatcctaactggcccatggtttatttctagccataaccagagctggggtaaaaagcagggcatgtctctgatcaaagcctggctcttaaccactacaccgtctttgcttccatatctggattttgaggcagaaaagttataactagggttagaagtttgtttgtttgtttcctggggtggggttaggttttaggtaatagactttggctaatttactgtcatggctcctacctgagtcccagttactcaggtggctgaagtgggtgcatcacttgagctcaggagttccaggctggagtgagctatgaccatgccactgccctccagctttggaaacaaagcaagactctgtctcttaaaaaaaaagaataagattttggttttggcttagattttttggattttattttgtgatatggttaccaagtagacagctgtcagaggtcttttatgggctgggcgcagtggcttatgcctgtaatcccagcacttcaggaggccaagatgggaggattgcttgagcccaggagtttgagaccagcctgggcaacatagtgagaacctgtctctacaaaaaatgcaaacattagttaggtgtggtggcacgtgtcaatagtcccagctgttctggaggctgaggtgggaggatcacttgagcccaggaggttgaggctgcagggagccatgattgtgtcattgcactccagcctgggcaatagagtgaggccctgtctcaaaaaaaaaaaaaaaatcatttatgttacttgtagattcctgcccacctgaagttatctgtcttatatatttcccctagtgactaactcttgttttacctaacctgaatttctcctatagaatgccttcttaagatatgctatctagtgactgtttggatttgtgattctcaacacagatgcatgttggaatcacctgggagcttttagtatgtgatggttcctgggcctcacctcagagggactgaaaaagaacctctgggcgtgcagtcctgaagtccatatttttaaagcttcctgggtgattctaaagtcagccaggattcccaaccactagattaggcacgaaatagactggtcgttctcactcttgaagaaccagacatctagacttgacaatagaagacgtgtgtaaaatggattgcagggaactgcggtcagggaagggtgacctttcttagcccacagccgtgttggggatataggagagcttggagatgccctcacaatcaggctgccaggggcaggcaaaagcaaacgagggtaaaagaaacttagcctgcttcgcatgtttgctgattgatttccaggcctgaggaagagattctgagactggggacagtgggaacacatgcttggcaggtggacagcagaagttgttttgaaactaggagtgcagaaatgctcccaaccagacttttgactggatacctgtcctctgcaactcagagccatgttttgatttgggggatgtttggggtctcctctctcatgccaaatattaggccaggtttcaattgcatcctctgtgataatagttctgggttttgacaccttttttttcccttttaggttcagataatgcacgtgtttcgaatcccactgtgatatgccaggaagacagcattgaagaggagtggatgggtttactggagtacctttcgagaatctctatttgtaaaatgaagaaaggtaagcgactggggtggtgcttctagttgagttttaagacctggttcaggaggctctgggaagctgagcagctgggtaacttggccatactataggttcctgctctttggaatgcaaaggcctgtctcaggaaatccattgtcagttgaagaaacaaattcatgtttgtgtggctcttgcagtcccagagccagcggcggtgattaagcgtttcaagtttgataaggcataggatgcagattacttaaaggaataagattgattcaaatgatctttgggctggtagctacacatagagatgggccttctgctcagctgtgtatcttaaaaacttgacaccagagattctcggcacctttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcgcttgcctcctctcatctcttttcaactatcttccaaatactgttgccacagctacatcataatgccaccactgtctgtttgagactccttcatgagcaaagattgatgtatggtaggtggataaatgggatgaggaaaaaaaaaataaaacaaggaacaaatgtttggggaatgccagtttagcacaaggtattaagtaggatgtaggattgcctacaaatatttgtcaactgaaatttcttgtaagctacttggagcactagtgcctaagagtcagtcaatgtctgtggggcagaacaatgccagagagtctgtgtcccaggagcgaggggacagagggcctcagagctggaggctggggggatgtttcttagaaatgtgcaatctaagcctcctttaaggaatggtgggacctgggcgcatagagaagaaattaaaggaattctgcactgaagactggtatgagccaaatcatgaatgcagtctgagaaaaagtgtgtgcaggtgacagtggagagagacacagtttccttggaaaaaaacatgatgaaggtaaatcaagggaaatagagcagaaatgtggagaccctctttctaggcccccatgttgctctgcactgggcattgccaaaaccccgttttcgggtctgttcacacacttgctgggtggttggaagctagtggccaagtctgtgcaatgaagtggttgagtcacctgacttctgagtcccttttgggtttatcgttcagtgcctcctgcagaaggaccacccacagtggttgtaggaaggtggccaccctgtgatgtgtgagtttagcctggatagaagacacttgacgtggggcaaaattaagggaaacaggaggcttggcccttccacaggcaacaatgagtttcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtgggtgtccccgctcagccagcttccggaggatgggcagtgagagagtgagagaaggaaaggggcagccaggctgggggcttacggtgttgagagagagggcaggtgtgggaaagcagggtacggtttctacggcagcaaacagttccgagtgactggaaaaaagacagttgtcttcattcatcaggttgccataacaaaacactgcaggctggttggcttataagcaaaaggaaggttcaccttacggttctggaggctgggaagtccatgatccaggctctggcagatctggtgtttggtgagggcctgttccctggtcgatggtgccttctcactgtgtccttacatggtgaagaggcaaggcagctctctggggtccctttcctaaggacagcaatcccactcctgagggctccaccctcataacttaaccacacctcaaaggccccatcgcctgatacgtcatgttgagggttaggatttcagcgtatggattttggggcacacaaacattcagaccatagaaatgggagaagaagagtaagacagagagaaaagtaggcagaactactcattaagagtgaggtggaaggtggagagggcagggagaccttatgaagatcacacatctgtgaggaaggtttgcacactctcactgaagccccggtaggaggctcagcacccatttctctagatagcaccttccttcctctgaggacagattctgactggagccctggtagggggctcagcacccatccctctagatggcacctgccttactctgaggacagactctcactgaagccccggtaggaggctcagcacccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctctgaggacagactctgattggagccctggcagggggctcagcacccatccctctagatggcacctgccttactctgaggacagactctcactgaagccccggtaggaggctcagcaaccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctcaggacagactctgactggaaccctggtagggggctcagcacccatccctctagatggcacctgccttactctgaggacagactctgacgggagccctggtagggggctcagcacccatccctctagatggcacctgccttactctgaggacagactctgactggagccctggtagggggctcagcacccatctttctagatggcagctgccttactctgagggcaggagcttgctttgtatgttccagtcccttctgagaaccagaagcctgagcatctattagaaatgcaggattgtggacccaatcttagacctagagagctagactttgcatttgaatgagagctacaggtgattcaaaggtgactgcatgtgtgggtgcagtggctcttgcctgtaatcctaggttttgggaggccaagatggggggattgcttgaagccaggaattcaagtcctacctgagcagcaaagtgagagcacctctctacagaaaaacaaaagcaaaaatgtgactgcatgttggagccacctggctttttttaaataaaaaagatccatatagctggacacagtgactcgtgcctgtaacctcagctactcgggaggctgaggcaagaggattgcttgagcccaggagtttgaggctgcagtgagctatgatcatggcactgcattccagcttgggtttcatctgaaaaaaaatttaaaaaattcatctagttccacctcagagcttctgattttatttccatggatgtggcctgggcttgcgattttctttttcttttttttttttttgagatgaagtcttgctctgttgcccaggctggagtgctgtggcatgatcttggctcactgcaacttccacctcccaggttcaagtgattctcctgcctcagcctccctaatagctgggatgacaggctcgtgccaccacacccaattaatttttgtatttttagtagagagagggtttcaccatgttggccaggctgatcttgaactcctgacctcaggtgatctgcccgcctcggcctcccaaagtgctgggattacaggtgtgagccaccatgcccagcctggcctgaggatttttgtgagcactcctgatgctgttgtgtagccaggagtgaggactgccctctgatcacccagcacagaacgttcagggccatgttgggacagtggactggtaagggcgagaggaggacactggggagcaggctgtagggtgccacagtccgccacagtcacaggctcatgctctccgtccgagaggaggcagaactgcttttaccaaggctcatccagccctcttcatttctctgggaacaatttttggtttcgtgacccatttcttaatccccggaaggcatttctctgaactggtgccaggcaccccggcccccagctccagttagttattattcgaggctgatttcttttctgtctgtcttccttctaattcctagattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggtgagtccccgtgcatgtgatctgtgtgagtgcaagttcatatgagagagagagagagaaacagactggagaaagatcttcaggaccaggttgctggtgtggtttctttcttttctttttctttttttctttttttgaggcagagttttgctcttattgcccaggctggagtgcaatgccgtgacctcggctcactgcaatctctgcctcctgggttcaagtgattctcctgcctcagcctcctgagtagctgggattacaggcacccaccaccatacccagctaattttttgtatttttagtagagatggggtttcatcatgttgtccaggctagtctcgaagtcctgacctcaggtgatccgcccgcctcggcctcccaaaatgctgggattacaggcatgagccaccgcacccggccggtggtgtggtttctgctgtaacaaagtgccacagactgaatggcttcaacaacaaaaattcattttcttgcagttctgaggccgaaagtctaagatcaaggtgtcagcagggttggtttcttctgaggccgccctccttggtttgtagatgcccccttctccctgtgtactgatgccatcttgccttggggggaagagtggcctagtctcctcttcttacagggacagcagtcctgatggattaggcacagtcaggcatgactacacaagacctaatgttaatctagtcactcctttaaagaccccatttcccaaaacagccacattatgaggtcttgaggattagggcttcaacatgtaaatttttgggggggcacagttcagcccagaacaagtgagaaggtagaatgggttggaggccagctggggaagttttgtgtggggaagaatgaatgaggaactaaaaaaaaagtcatttcttgaaacaaccatgatgctcgatatattccatttcctcatgggccatgttcatagatgagagttggagaatttgccatttacaacaatggcaacctcacctaaaaactatgaaaatactttttttttttttctttgagacaggacctctctctgtcacccaggctggagtgtgtgatcacagcttactgcagcctcgacctcccaggctcaagcaatcctcccacctcagctcccccgagtagctgggactacaggcatgcaccaccatgctggctaatttttgtattttttttgtagagatgtggtctcatcacgttgcccagcctggtcagaatgctttgtatgggttgaaatgtcacagggaatctcctgtgactttattaataatgtgcttgctcacacctgtagtcccagctactcgggaggctgaggcaggagaactgtgtgtacccgggaggcggagatggcagtgagccgagatcgtgccattgcactccagcctgggtgacagagcgagattccatttcaaaataataataataataataataataaaaaatgtgcttgctttctcccacaccatgaatcagattcacacgccccaccgcgctggtgcctgggccgcctcactagctctgtttcattccctgctctgtggacgcatgcaggcgtctgcatttttgaggagctgcacagcaagtgttaaagtccgccactctaggacattttgctacctccctctccggctcaacacactcaccttgtcaccagtcttatcaatttttcctcctacccgagctgttttccacttttcctcgtcctcaccccaccagcccaggtccagcaactgtcaccacttgcctggacacgcagtgacctcctagaccatcagctccccggggatggggtttgcgtttgtttgtcttgctgtcatctttgccacgcctggacagacatcttagtacccatcagtggtcaaaagcacgcactgaatgaatgttggctctttggtctccctgtgtctgcctttttccctcacccgaccattctctgcacaaaagtaagatggtcctttagaaaattctgattcgattgtgctgttcggtggcttaaatgctttctgtctgctctgctctttattttttactttatgtatttatttttgtagatgtagggggcgcaagagcagctttgtttcatggatatgttactgcacagtggtagtgtctgggcttttactgtaactacccctttttttttgagatggactctcgccgtgttgcccaggctggagtacagtggagtgatctcggctcactgcaacatccacctcctgggttcaagcaattcttcgagtagttgggattacaggcatgggccaccacgcccagctgatttttgtatttttagtagggacaaggtttcaccgtattggctaggctggtctcaaactcctgacctcgtgatccacccgcctcggcctcccaaagtgctgggattacaggcgtgagccaccgtgcccggccttagtgtaactcttacccaaatagtgaacattgtacccaataaataattttccagccctcacctggctcccaccctcccacccttctgaggctctagtgtctatcattccatgctctatggatgttaccctttgtttagctcccacttgtaagtgagaacgtgtggtatttgactctgtttctgagttgtttcacttaaggtaatggcctccagttccatctgtgtggcttcaaagatgtgacttcattcttttctatggctgagcagtattccattatgtatatagatcacactcttcatctttgctcttttggtaaatttcaaatcgtagtgccatggagactggttgtttgggacatttaaccttatttctccaacttcatgcccaaattctctccccactgccattgcccctgtatgattctggagaggcagacacaaacagggaagggtaggggacagtgagatgcttcgcagagaagtagagatccatttgtccatttgcttgaagttggtgtaaggatagggacagaaaggaaggtggtctaacaggctccaggacctatgaactattgccctggaaagaagctagaatgttgttcttgcccccatgacagggataaagtatagtttttgttgctggtggtggtggtgacggtggtagtgatgtgcgtgtgtgtttgtgtgcatgtgtgtgacggggaaactaatcaagaatcagagctgcagcgggatgtggaatcccagcactttgagaggctgaggtgggcagatcacctgagcccaggagttcaaaaccagcctgagcaagctggtgagaccttgtctttagaagataataataataataaaaataaaatataaataaaataaaatggctaagcatggtagcacatgcctgtatttgcagccacttgggaggctgaggcaggtggatcccttgagcccaggagttcgaggtggcagtgagctatgatctcgccagtgcactccagcctgtgcaacaaagtgagaccctgtctttaaaaaaagaaaagaaaagaaaagaaaaagaatcagagctgcttttcctttcaatatagatggagggctgggatgaaatcgtcaaacacaatggggtgacaatgttggtgaagacaagaaatagctgagtgcagcactggcgagggcagtgccgactgcgggcacgtcaatggttaggaacacgagggaaggaggtgggtgcacaggcccacaccgcccgcttcacttacaaaccaggagcgcaccattcacatgtctggggggtgatctcaatgcacccggcactgtttacggccgggagttcactgacaggtgatccctctgctgtgactggggagactgggggctgacctcccaatgtgccttgtgctgtattccggagctctctggtcaggtgtattctgatgctttctctattccagagctctctggtcaggtgtgtcctgatgctttctctattccagagctctctggtcaggtgtgtcctgatgctttctctattccggagctctctggtcaggtgtgtcctgatgctttctctattccggagctctctggtcaggtgtgtcctgatgcattctctattccagagctctctggtcaggtgtgtcctgatgctttctctattccagagctctcttgtcaggtgtgtcctgatgctttctctattctggagctctctggtcagatgtgttctgatgctttctctattccggagctctctggtcaggtgtgttctgatgctttctgtattccggagctctctgatcagatgtgttctgatgctttctctattccggagcttcctgatcaggtgtgtcctgatgcttcctctgttctggagctctctggtcaggtgtgttctgatgctttctgcctctgttcttggcatgaaggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggtgagtcgagcccgttcccctaaggaagttctgccagcgaggcgtgctgcgcactctggcttcagtgaggcccggtgggctggggtttgagtgagaatggccttggcggctcgggtgactgcgtgtgcttgtcttggggtgtctagcattgcggtcagtgagtgtttgtcgtggggaaagccacacactcaaccctgacaaggagcataaataataacaaaaagaagatgtctgcctttagggtgcctactgcctagctgacaaaaagaaaaaatcagtgtaatgcattgctttagaggagttttagaacttcatgacaagccctgggtcctcatattgtataagaaaaatggtgctaaagcaatgcagaccctcgatgttgtatgcagcccttccctgagtgcttctgggagacttgcattttgaaggagagaaaaaaccacttaaaaatggaagggccatttctcacccattaggatggctattatcaaacaaaagcaagaaaactagaaaacaacaagtattggtgtgggtgcggagaaatggaagccattgtgtgttgctggtgggaatgtaaatgatgcagccactatggaaaacagcacagcaattcctaaaaaataaatacagaattactactggagccagcatttccactgctgggtatatctgcaaaagagttcaaagcaggaactcagccaggagcggtggctcacacctgtaatcccagcattttgggaggctgaggcaggtggatcactggaggtcgggagttcgagactagcctggccatcatagtaaaaccttgtctctactaaaaatacaaaaattagccaggcatggtggtgcatgcctgtaatcccagttactcggggtggaggcaagagaatcttttgaacctgggaggcgggggttgcagtgagtcaagatcccgtcactgtactcccgcctgggtgacagaggaagcattaaaaaaaacagaaggcaggaactcaaacatgttatttgtacatctatgtccatagcaacactattagaaatagccaaaaggtggaaataaccaaacgtccttcaacggatgaagggtgttgaaaagtgctatatatgtacattcagctttaaaaagaattctagtacacactacaacatggatgagcctcggggacattatgctaagtaagataagctagactcgaaagggcaaatactctgattgtccttataggaggtgtctagaacagacagattcatagagacaggaagaaacgtggttgcaggcaatgggagggcggagagtgggaagacattgtttaatggttatggagtttcagttctgcaagatgaaaggagttctggagatggtggtggtgatggttgcacaacaatgtgaagtgcttaaggccattaattgtgcacttaaaaatggttaaaatggtaaattttattttacacgtattttaccacaataaagctgaatgtagggagctgggaagatgtagtattggtgggagcttggagaatgcttacttgttattccaccaaatggaaaaggaaatcagaagtgtacatagagcttgtgtccactccctttccatgtgtaaactggagtagaggcagtggcaggtacgggtgcttccttgtccatggtggagcgtgggtgagagacatgactgacattctgccatctctatggaaggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggtaagtcttcatgggtgtcttaccagaaaagtaacttcttttcagaggtgaattatttggaaaatgtggatgggggttactttggtcaggcagagctgaaggtagagtaaggaggtaaaaacatcagaaatgctttgaaggactggaggcatataatgtatactgctgctaataagataatttatgctaatttatgattatagaactagagtttcttagtgttggaagaaaccttagagatggtgcagcccaattgcctgttgagggaaaaacttgcttccaagacactcacatgaatagtcacccattttatgtgtgcatgcttgcaagcatgcaagttatcgcatagtgcatgcagcctctacactaggaaagagctctcaccctgcagcctctacactaggagaggactcttacactgcagcctctatatcctcaacagtgtcatggctcagcaccttcacctatgtagccatgctctcccaggtacacaggctggtttgttagtgtctgtctttgaaatgtggtgcccagacctgatgatgcatggtggatgttttacctcctgttgcagagaactatggtttcactggtggaatctctgatttccttgttttttttggcagttacataagccttttgattcatgttggaattctgcagtaaacagtagtagggaatacccactaataatcatgcactttccctgtaccactttcctgtatcactttccctgtatcacctgctctttcatgttcttacatggattttctcagttggcttcagaaagatgctatagggtagggtatctgtgtctccaatttaaagaggagaaaataaaattcagggagcctcataactttgtccaaggacactcagagagaaggtagtggaactcagtgtagacaaacgtctgtgacctcccaagccactgccttaattcccagtgcattgccttaggagatgttgctaatgggctctctacagggcttcttcatctggctctcagcttaagggtgggacctccaatttagctttgctaaacctcatcttacctgtcttttgacccattgactaggcagttttgaatcttcattctgacaataatatctacaaatacaataagcaaattggataggtcttcattcattcacattattaatatatataccagccagatcagcattcaagacaaaatttggcaggaaaggtcttcccagaggagtaatccactaatccataattaacaaccaacctctgttcacaaagctctgatacttccttggacctctcccatcagccaatcctcagatgtgaccatatctctttctatgaagtcttcctgcagtgccttcatttcctcgccttagggtattacccttccttagcaaatcgccttagaatattactcttccttggcaatttgacttctgcttctctaagtttgttcaacagacatgattttgtcccttcattttgcaggccctctgggggctctgtggtgggcactgacagcagcagtgagtaaaacagaccaaaatcctgttttcacaaccgttcttttagggaagtgataacagataatagacatgctaaacaatataccctgtgtataagagctataagaaaaactggagtgacggcgaggggtgcttctctgctcacgtttggcgagtgcctctccgagcgggtgacattggagcaggtgctcagtgaagcgtgggatgggctgtgaaggagccggaagagccctccaggcaaagcagatggaaccgaagaggcccaggcgtaggcactcaggtgactctcagtgatcctggttccaaattccacatgacaaacaagccaattacaaatgtgcctgatgcatctgtaatatgctctatgtagttactattgtcaatacctaacctggtagagctgctgtaataaagtatcacaaacagagcggcctaaacaacaagagtttattgcctctcagttcaggaggccaaagtctgagactgaggcatcagcaggctgggtccttataggtcgtacaggtccttcccagtccttactttagttgacatctgctgcctttaattcatttcactcttcctctttggaagccttcttcgctcttatttttaggtcactacttagtctttcctgctaatgttatagcttccccctccctggatcctgcattggcttctcttcctgtggtctggggatttcacgactggtttagttgtgtttttttttttttttttttttttgagttggagtcttactctgtcacccaggctaaaatgcagtggcgcaatcttggctcactgcaacctctgcctcccgggttccaacaattcttctgcctcagccttctgagtagcagggactacaggtgtgcactgccatgcctggctaatttttgtatttttagtagatacggggtttcaccatgtttgccaggctggtctcgaatttctgacctcaggtgatctgcctgccttggcctcccaaagtgttgggattacaggcgtgagccacacacccgcctggtttaccttttttgttgttgttgttactaaatatttctaaactccctgagaattctcatatacctctcaatttcaacaacagtaggtctcaaacccagatatcattcacaaactttttattagaaaagtaacacatgcttggtgtaaacatatcatagtacagacaaagtggaaagtgaaagctccttctcagccctcttctgagagagccatttacaatagtctgatgaacaaccatccagactttttttaatacaatagattgttatataatccattcatctgtccatccatccatccatccatcatccatccctctattttccatccgtcaatccatccatccatccatccatccatccatccatccatccatcaatccatccaagggagtatcagagctttgtgaacatatattggttgctaattatggacaaatggatttcctgtatatgctgatctgggtggtatttatatcagtaatgtgaatgaagacctatgtgattttcatgttgcatttgtaatacattgttatgtagtattttaaatgcctagtctgttagagctactgtaataaagtatcacaaacagagcagcttaaacaacagaaatttattgtccctcagttctggaggccagaagtgtgagattaagatgctagcaggctgggtccttctgagggctgtggggaatctgttcatgcttctctttggcttctggtggaatgtcatcttgctgacacattttgccattccttgacctgtagatgcctctgccacaccattgcctttatctctacgtggtgtcttccctgtgtctgtgtgtgtctttctccatgtcccaagtttccctgtgaaagaacacaagtcatgttagatttgtaacgacctgatcttaactaattacattttcagtaaccgtatcaccaaataaggtcacaatctgaagtactggggcctaggacttccacatataaagtcttagaggaaacaattcaatccataacaccctatctattgaaactagaaccataatataaatatttttctgtgatatccttttttcatttatcatggataaatttccatgctgatttgtgtagatctatcgattggggcataatatcccatagtgtgctttaccataatttatttaatcaaatcatgcattttgggataactgttcttttccactattacaaacaactctgcaaaaagcacatttgtatatatagttttatgcatgtgtatttgctttgagataggtatctataagtggcattaatcagtcgagacttttatgcattttatgtgttaggtacagccatacatgtggctgtgtgttaggtatagcctatgggttaggcatagcctgtgtgttaggtatagcctatgggttaggtatagcctacgtgttaggtatagcctatgtgttaggtatagcctatgtgttaggtatagctacatttttttctctcgaactttgggtcctcatctctggctgcatattgtgtactgcctgtctcaatactgctcaagggtcacacatgctgagcatttgcaacattggtttaattatcataccccaccttccacccccgttctctgacctgctcctgccctcttcctcctgcctcattgaatagtggggctttccaggaggctgctgagtgagtaaacgggggacggtcctaaatgctctgctttcggttccctctaccactcatcactacaccagagggaactttttaagatgcaaatttgaaaatattgaccctttgttcaaaaatcttcaaaagttcttctctgcagtcagagtgacatcttagcttggcacacaaggctgtccctgatactgccctctctcctgccataccttgcactccattttgagtcatattggatgagttttgttttgctgttttagagatggggacttgctatgatgctcaggctgaatttgaattcctgggttcatctacagccataccacccagagtgcctgatctcatctgcactcctgggctcaagcaatcctcccgtctcagccgcccaagtagctgggactataggtggacatcactgtgcccagctatgaattagttttgaaacatcttggtggttcttttaatcttccttattcttgctactcttttccttttgcctggaaggttacccccactttcccactttctactatccatctaagaagctcctacttattttttaattactgtgatcctcattttgtccatttaaaagcagggataaaactaacattcccatcttgaggttgtgatcattcaatgagataaccctgtttaaagtcgtcatccatgtcaagcacacaataaatactcaaaaaatgtttgatcttcttcttcagattccttccttccttccttccttcttcctcctcctcctttctttctctctttttctttttctctttctttctttctttctctctctctctctttctttctttctctttctcccttcccttcccctcccccccccctttccctttcccctttcctttccttattttcctttcttttcttttctttttttaagacagggttttgctctgtggctcagactggagtgcagtggtaggatcatagctcactgtagccttgaactctcctgggctcaagcaatcttcctgcctcagccttctgactagctaggactacaggtgtgtactaccatgcctgggtaatgtttaaaatgtttaaaattttttatgtagagacagggtcttgctatgttgcccaggctggtctcaaactcctggcctcaagtggtcctcccaccttggcctcccaaagcactgggattcagttttcattatgagacagttttgtgacataggcaggtagttaataaataaaaatccccaaccaattaacttaatacagtacatggcaagatatccgtgcttggtaaatgtagagctcagttaggtggattggttgaaatcgagatgtcaatcacattcctctaatccaaggattggttggtgggacatggttgtttgattctttaaacattttattatgtgttcagtgtaaccgttgcttaatagttaccagcattttcacaatttggatatgacgttttcttaacaaaactgcaccgtctgttgcaatttctactactactgtgtagtgctccccaaacatctgttgaataatccattctactcctttttggaaatagtggtaaagcctgcataactttaattacataatttaaaaaatattttctcttttcctctttgaagaccatccccattctactagaatgtccctggcctttgccaggaatgctactaatcccttctgcatgttaattaacaacaaccctctgatagaattcttaccggggatgagagcttagtagaagccactcaaaacttgctttgtttttgtctgtctctcttgggcttcatttgcctattagtcttacttactgtgtcttttcagtttgactcttccttaattgggaagatagaaaccagtggatggataatcactttttcctgctggtcatctgttcatgctttactgtctgaatacactttttctgtatttctatttttcctgcctcgtagacaccaaagagcttaaaaaacatgccattgccaaggactctggcaggaaggaggcaatcacctgcgctattcctggcttcatggaatagaagcatctgtgctcctaggaattacgccaccagtgattttagagctcttatgctcttcctgggtgatagaatgggcttaatttgactcaagaatagtacatcaaaactcttaattccatcgagattgatgcatttttggggttttatgctctaaaaggccttttgctgtgcagaaggaagagagaggtggacagaaagggcagtggggagaagatgagactaaaaggtggaaagtccaggtctggatccctccccaccacacacctgctctgtggccttgagagaaacatgtaatttttataagccttagatttctaatatgtaaaatgtatgtaatagttttagctgcactccttccttgccaggttgatataataatcaaataagactggtctctgggtcaggcacagtggctcatgcctgtaatcccagcactttgggaggccaaggtgggtggattgtctgagcccaggagtttaagactgcagtgagctgtgcacttggcctgggtgactgagcaagagcctggctttttctatttatttatttatttttgagacagagtctcactttgttgcccaggttgaagtgcagtggcaatctcggctcactgcaacctctgcctcccaggttcaagcaattctcctgcctcagcctcccaagtagctgggattacaggtgcccaccaccaccctaactaatttttatatttttagtagagatgggctttcaccatgttggccaggctggttttgaactcctgacctcgtgatccaccctcccaaagtgctggacctcccaaagtgctgggattacaggcataagccactgcacctggccttatttatttatttatttaggcagggtctcactctgtcacccaggctagagtgtggcagcgcaatcatggctcactgcagcctcgacttcctggactcaagcgatcctcccacctctccaacgtggttgagggctgcagcgagaaagatgtgaaaggggcatttgggggcgcaggaaggcgggaggtggcaattgctaagggccccgccgtgttcctgtcacagccctagctacagcttagaaggtcacaatggacgttcacctgttgtctttgatgtttaaatcagcaccgacttcccatgaggaggatttttttttcctgtctctcttaaaaaaaaaaaaaaaggcccctgcagtgtgggtgtctgcagtgttacggggattattagttgaggataaccactgggatgtgtttctggaagaagtggtgctgaggagcactcctggccggaggaaagctgtgtgaggaggaggaggagtatggggtaactggctcagtttgccttggctctttctgtcggactcatacagcaaagcatctgctgagacatcatttgtgtctcctgtgacagccagagacagcaggtcttgctctccccagatcatatctgagatgctggctcctgctctctgagctgaaggctgcagctgctgagagaggacgaggcactgagtcaaagcagctgcacaatgttggggaacagctgggtactgaggactcttctccctgtccttctacaggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggagtaagtcctttggtttattacagcaatgagaacacatggtggccaagggtggagggacgtttaggcagagtggccacaagataatctgtatcttagaagtgaggtgtcttcttagtgtttgccttgttacaggatcatgggactgggaggagtccttccagatgatatagatgtaggaacttgagtccttaccatcacagttttctgtaccacaaaacaaggagggcagtatgacacttacattttatggaaatgtagggaaaggcacagaatttggtaaatcaatgaacaaaccactgttactaatttgatctgtgcaatgcagtggatttgaaaaagagagagaagaataattaccagcatacaaggctgcttgaagctagttagtcctgtgctcctgtgctttttttttttccacctgaaacaagacaggctaagatgctaaaatcttggggagctagggggatggttaaggggacattttctttaaatcaccccctttttgcagattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggtgagtgtgctctgcagagatgcccgtggtgggactctgagttctcaggaaacgttgactgttatcaaaatccaggatggctctcgcttcatttgcagccactcaagattaggttgggcctgggtcagttgtggtggatattttaaaatagagaatatggggttaaactacacattccacttcactgagatggttagaatcaccaaggctaagctggatttcacccacattccccaaagaaacacaagccctcatgcgatcatggccaaggaggattctgttctacacaaggaaccgaacttcgtagaactcgtctatgggtcatccaaattggaagggtctttacatagtggggatcttgttgttttgtttctgaggatttattttttttttccttgagacagagtcttgctctgtcgcccaggctggagtgcagtggcatgatctcggctcactgcaagctccgcctcccgggttcacgccattctcctgcctcggcctcccaagtagctgggaccacaggcgcctgccaccacacccggctaattttttgtatttttagtagagttggggtttcactgtgttagccaggatggtctccatctcctgacctcgtgatctgcctgcctcggcctccccaagtgctgggattacaggtgtgagcctccgtgcctggcggtttctgaggatttctaaatgggaaaagagtgctccaggaatagcaagatgggaaattacacgaaattcgacagtgtgtcaggatattgccagcccacctctgtgatactactgaggtagtcgtctcctctctagcaagagcttcctggcgagtcccacggttctgtcagccgtgatgattgcacttttccctgaagacgttttcactgcttggctttaaggccaacatgctctcctgggttttctcctatttcatcagatccttctactcagtctcctttctggcctcttcttcatcatcctgacccttatgtgttgaatcctcagagcttagtcgctgggctaatttttcttccctacactttctccctcatttaaattatctggtcttctggcttcatgatatgtgtgctgtggcctccagattatatgtccataaattctgtgtctccgtgcttggctgatctttcttcttgaaggtttaataaacctctcaaacgtcacatctagatccacacccttgctactctcttctacccgaaacctgattcttccccatttcagtcgatggtcacttcctccaagttgctcgggccaaaacatttctggttctgtcgtcactgtctctttttccttataatcatgtccaatgtgtcagcacatcctgtgagctctgccttcccagcttggccactccctgaccacttcaggccagcttcacggcttcttccttggctcaagccaccatcacctggtgtctggattgtcatggtggcattctgacaggtcaccctgcatctgttattctgattttagcagacaagggattcagctaaaacgtaactcgcatcatatcactcttgtcaacatcgtcttcttatcactttcataatcagagcaacaaactcatggtggcttccatgccccacataatccagcctctcctgcttccgaagattccgcttctcccaacccttgcttattctgccccagtacagtgatctccttgctgttttgcaagaacactgtcatctctggatttttgcacttgcttttcttctggcctagaactctctccccttcagtatccacctgcattattccctgtaccttcctaaattctctgcttaaaggtcttctctgcgaggctgtctttgactattctactgaaaatagaagcactttttcttctcttctcattctcctctgcagtgtagcacatcttatgtgctatgtcattttcttgtttatttattatctatctctgctcccaaaatataaattccattagtccagggacttctgtccatattaatgatctcaaggctgagaacttgttggaatgcaggtttgaataaatacaagtttgaatcagccttgcatccttgtgccaacataatggagcacatttgctgcaggacaagccaatattcccagagctaagagagatgggggaacaaacaaaggattggtcaggtcaaagctggggacactgctacatgtagcatcactgacctagccctgagggacattctggacccaggctgagggacaggctcaaaatagattgaagaatccatgaatgcaatcaacccgttttctcaggctgcgataacaagctgctttagactgtgtgactcaaacacagatttattatctcacaatactggaggctagaaagtccaaaatcaagtctctgatgaatttggttgctggcgagagtcctcttcctgatttgcagatggctaccttcttgttatgtgattgcatggagggaggggaggcaagggagagaagacaggggagaaagaacaaactctctgatatctctcctgtaagggcactcaccccatactgagggccccaccctcacaacttcatctaactctaactacttcccaagggcctcacctttaagtaccgtacattaggggttcgggcttcatcatgggaattgttaaggaagacaaacattcagtatataacaccaccaaattgagatggttataaatggtgcaggacaaatgggtggatttattagttaagttgcaagggaaactttattaaagaggaggaagaacttacatcgaagatgtgagaggcatcctgggcaaatgcaatgtgtagaattgatcaggttagtgactaaatgaacataaggtaaaaaaatttacaagacagttgaggaagcgtaaatgctgactggacatacagtgatactaagaaattattgttaaacgattttggtgtgatagtgacattgtaattatattttagtgtcacaaagtgaattattgatagatgcattaaatgcagtatttaaaataatccatgggtgggaggagtgggtgggcaatagaagaaacaagttgacatgacctgtttaattgtcgaacttgggtaatggacacagggggttcattatactattttctatacttttatgtatgcttaacattttcccaactagatagttaaaaatataacaggaaccacattgggcacttagagcttttttttttttttccccacatttttattgggagccgtgggaggggcctcctctgtcattggaggtgctcacagtttcttcagccactccaggctggggtcctgggggtctgaggctcccagtgacgaaggacacgacgagcaccggctccttggcccaggcattcttgaagaaggtgcggagtctcgcggccatcttggtctcggcggcggcgacggcggcgaggacgcggagcactctgggagttgtggtccctcttttttttttttttttttttttacattttagaagtgtgtggagtttagggaaatgaagagatgagacttttaaggttaacgactctgacagagttatctgaagagtgcaacccaggctttctatttgcttttacaggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaa

SEQ ID NO: 1893 - DNA, 31056 bp, Homo sapiens; identical to SEQ ID NO: 1892

SEQ ID NO: 1894 - DNA, 31056 bp, Homo sapiens; identical to SEQ ID NO: 1892

SEQ ID NO: 1895 - DNA, 32949 bp, Homo sapiens
gcatttcctctctagctgttcctgaggctggcatctgggtaagtccagctccgcggggcagtgtgggcgacaggaccgggagagcagtgggggagattgtgttcagagggcagaacttgtcctggttaatgcactaggaatttcttctggcgtctccaaggttgtgcttcaacaacatttctggaatgttcttttatcattatttgggctctacgtgtgcaagttcgtgtgtgtgtatgtggcggggggaagcggggaggacagcggcagcaaccatagtttacacccacgacttcagcagatttgcccagtatccctcccaggggagaagatggatgggatatacagaaggaaacaaacctccttaaagaccaaagggcagcagatttttgtgctggtgttagggtggaaggagcacagaagaaaggcagaatcctgatgcagatggaaggactgatggggcaggagctgggagggtatgcggagctaatagggctgtctggagagcagtcacctcaggatgggcaggagctgggagggtatgcggagctaatagggctgtctggagagcagtcacctcaggatgcacagggctgggtttgcagggctcaggaggcgaggagtagataggcaggaatggagatgggacgggagagatgagtgagtctgaggcatcttgacattgaactgcagtcacagaaattccaatttggagagctccaccgttttccaggctctctgcctcccttgagtgttatttatggctttaggttgaggtgctttgccaaatagagtataatcaagggatcaaggagggaacaattccaaacaaagccaacttgttcatccatccggactctaggagatatggaagatctaaagatacagcaggtgattgctagtttttgtggaactcacagtctagttgggaagactatgttggtgaatgctgcagtgatacacctgtgataaatgctggggaagtgtgtcttttagtcatctattttgttgtctttgtctttgtctgactgaaacaagtgatggaagacatggtctcatatctctggtcaaaatcctggctctgttccttcctggttctaaacccctcggcaggcttcctagtccccctaagactcagtttatgcatctataaaatggggctaggaataggtgcacctcatagagctctgtgcaggttagatggggaaaaacatcagtgagtgcctagcctgtggaaagctctaaattaatgtgaattataatgataacaattgcgaattttgcaaggagacattaaaggatgtatgtttttatttattttattttattctattttattttttgagatggagttttgctcttattgcccaggctggagtgcagtggtgtgatcttggctcatcgcaacctccgcctcctgggttcaagcgattctcctgcctcagcctcccgagtagctgggattacaggtgcctggtaccatgcccggttaatttttgtatttttagtagagacgggatttctccctgttgtttggtgagcctggtctccaactcctgacctcaggtgatccgcccacctcggcctcccaaagtgctgggattacagggatgtatgtttttattattctccattatgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggtgagtggaaggaagacttttaaaaaaaattgtggccaagtgcacatagtgtacaattttccatctttatatatatatatatatatatttttttttgagacggagttgctcttgttgcccaggctggagtgcaatggtgagatcttggctcactgcaacctccacctcccgggttcaagcgattttcctgcctcagcctcccaagtagctgggattacaggcattgcacctccacgcccggctaattttgtatttttagtagagatggggtttctccatgttggtcaggttggtctcaaactcccgacctcaggtgatccacccgcctcggcctcgcaaagtgctggaattacaggtgtgagccaccgcgcccggccgtaataatttttaaatgtacagttcagtagtgttaggtacactcacattgtgcaaccagtctccagaactgttttcatcttgcaaaactgaaactcctcacccattgaatgataactcctcattgcctcattctcccagccctggtaaccaccattctatttgccatctctgtgaatcttactactctgggtacctcatataagtggaaacatacagcattttttcctttatgagtagtttatttcactcagcataatgtcctccgggttcaactatgttgtagcatgtgtcggaattcccttcctttaaaaaagactgtataaatactccatggtaccatataccaaattttgtttagttatctgttgatgaacacctggattacttctacctttttgttattgttaatgctgttatgagtgttggtgcacaaatatctcttcaagaccctgctttgaattctctggggtatatactcagaagtgaaatttctgaatcatacggtaattctgttaaatattttgaagaactgctctactgttttagataccatctgcaccatttcccaccaacagcacacaagggttccaatttctccatatcctaagaacacgttatttttatttattttttcttttttatagtagccattctaatgagtgtgaggtggtatctcactgtagttttgatttccgtttccctaatgataagtgatgctgagcacattttcactgcttgttggccatttatagagcttcttcagagaaagttctgttcaagttcttttctcattttcagaccaggtttggcttttgttgttgccttgtaggagttctttatgtattctagatattaaccccatatcagatatatgatttacaaatattttctcctattctgtgggttgtcttttcatttggttaactgtgtcctttgatgcacagaagttagtatgatttttttttttttaaatcatggccgggcatggtggctcatgcctgtaattccagcactttgtgaggctgaggtgggtggatcacctgaggtcaggagttcaacaccagcctggccaacatggcaaaaccccatctctactaaaaatacaaaaaaaattagccgggtgtggtggtgggcacctgtaatcccagctactcaggaggctgaggtaggagaattgcttgaacatggggagtggaggttgcagtgagctgagattgcaccacggcactccagcctgggctaaagagcaagaccctgtttcaaaaaaaaatttttttttcttgtattgtcttggttttttctcttttcccctctcacggtagtgctatgagaaggtggaggcaaactgtttgctttctctaactcctttaaaaagctgatgcagactgtacctaccccctgggcacctgccatgattagtccctctttatctgaatctcagcagtgcctagacctgcctccaattctccatccagcttctcagaccacatgttttgtccagtatctgctgtgtggtcagcaggcttgggcctctgcttcctatggcccagagggcagcctctctccttgaagaaccgtggagtttggggcagaagcctttcctttcaccaccactttgggaattggaatgtaaaagaaattctcttaatccccatgtacacattggggataaggttctttcttttgtcttgtgttctaggcaaaggtagggctcagagaagggcagggtattgcaggatgatgatgtagagctggtggtgatgggaaggaggagtacaaatgagtcagtggatagggagacacatgttaaggcagggcagcagtgtgggtgtaatgacactggggaaacagacagcagtgtgcagccgggggaggtcagaaaccagttgctgcaatggctctcacctgtagtcccagctactcaggaggctaaggcaggaggatcgcttgagcccaggagctcaaaaccagcctgagcaacatagggagacctcatctctaagtaaataaagcaattatcattgtgtcagtacttatatactcacatacccaaatgaaagtgtcataatcacaactgtagaagtactttgctaagcagtttttatggattttatggcacattcaagaaacccatgaaacagcttctggtattatccctcctgcaagtgaatgaggtgagcctggaagagatcctaactggcccatggtttatttctagccataaccagagctggggtaaaaagcagggcatgtctctgatcaaagcctggctcttaaccactacaccgtctttgcttccatatctggattttgaggcagaaaagttataactagggttagaagtttgtttgtttgtttcctggggtggggttaggttttaggtaatagactttggctaatttactgtcatggctcctacctgagtcccagttactcaggtggctgaagtgggtgcatcacttgagctcaggagttccaggctggagtgagctatgaccatgccactgccctccagctttggaaacaaagcaagactctgtctcttaaaaaaaaagaataagattttggttttggcttagattttttggattttattttgtgatatggttaccaagtagacagctgtcagaggtcttttatgggctgggcgcagtggcttatgcctgtaatcccagcacttcaggaggccaagatgggaggattgcttgagcccaggagtttgagaccagcctgggcaacatagtgagaacctgtctctacaaaaaatgcaaacattagttaggtgtggtggcacgtgtcaatagtcccagctgttctggaggctgaggtgggaggatcacttgagcccaggaggttgaggctgcagggagccatgattgtgtcattgcactccagcctgggcaatagagtgaggccctgtctcaaaaaaaaaaaaaaaatcatttatgttacttgtagattcctgcccacctgaagttatctgtcttatatatttcccctagtgactaactcttgttttacctaacctgaatttctcctatagaatgccttcttaagatatgctatctagtgactgtttggatttgtgattctcaacacagatgcatgttggaatcacctgggagcttttagtatgtgatggttcctgggcctcacctcagagggactgaaaaagaacctctgggcgtgcagtcctgaagtccatatttttaaagcttcctgggtgattctaaagtcagccaggattcccaaccactagattaggcacgaaatagactggtcgttctcactcttgaagaaccagacatctagacttgacaatagaagacgtgtgtaaaatggattgcagggaactgcggtcagggaagggtgacctttcttagcccacagccgtgttggggatataggagagcttggagatgccctcacaatcaggctgccaggggcaggcaaaagcaaacgagggtaaaagaaacttagcctgcttcgcatgtttgctgattgatttccaggcctgaggaagagattctgagactggggacagtgggaacacatgcttggcaggtggacagcagaagttgttttgaaactaggagtgcagaaatgctcccaaccagacttttgactggatacctgtcctctgcaactcagagccatgttttgatttgggggatgtttggggtctcctctctcatgccaaatattaggccaggtttcaattgcatcctctgtgataatagttctgggttttgacaccttttttttcccttttaggttcagataatgcacgtgtttcgaatcccactgtgatatgccaggaagacagcattgaagaggagtggatgggtttactggagtacctttcgagaatctctatttgtaaaatgaagaaaggtaagcgactggggtggtgcttctagttgagttttaagacctggttcaggaggctctgggaagctgagcagctgggtaacttggccatactataggttcctgctctttggaatgcaaaggcctgtctcaggaaatccattgtcagttgaagaaacaaattcatgtttgtgtggctcttgcagtcccagagccagcggcggtgattaagcgtttcaagtttgataaggcataggatgcagattacttaaaggaataagattgattcaaatgatctttgggctggtagctacacatagagatgggccttctgctcagctgtgtatcttaaaaacttgacaccagagattctcggcacctttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcgcttgcctcctctcatctcttttcaactatcttccaaatactgttgccacagctacatcataatgccaccactgtctgtttgagactccttcatgagcaaagattgatgtatggtaggtggataaatgggatgaggaaaaaaaaaataaaacaaggaacaaatgtttggggaatgccagtttagcacaaggtattaagtaggatgtaggattgcctacaaatatttgtcaactgaaatttcttgtaagctacttggagcactagtgcctaagagtcagtcaatgtctgtggggcagaacaatgccagagagtctgtgtcccaggagcgaggggacagagggcctcagagctggaggctggggggatgtttcttagaaatgtgcaatctaagcctcctttaaggaatggtgggacctgggcgcatagagaagaaattaaaggaattctgcactgaagactggtatgagccaaatcatgaatgcagtctgagaaaaagtgtgtgcaggtgacagtggagagagacacagtttccttggaaaaaaacatgatgaaggtaaatcaagggaaatagagcagaaatgtggagaccctctttctaggcccccatgttgctctgcactgggcattgccaaaaccccgttttcgggtctgttcacacacttgctgggtggttggaagctagtggccaagtctgtgcaatgaagtggttgagtcacctgacttctgagtcccttttgggtttatcgttcagtgcctcctgcagaaggaccacccacagtggttgtaggaaggtggccaccctgtgatgtgtgagtttagcctggatagaagacacttgacgtggggcaaaattaagggaaacaggaggcttggcccttccacaggcaacaatgagtttcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtgggtgtccccgctcagccagcttccggaggatgggcagtgagagagtgagagaaggaaaggggcagccaggctgggggcttacggtgttgagagagagggcaggtgtgggaaagcagggtacggtttctacggcagcaaacagttccgagtgactggaaaaaagacagttgtcttcattcatcaggttgccataacaaaacactgcaggctggttggcttataagcaaaaggaaggttcaccttacggttctggaggctgggaagtccatgatccaggctctggcagatctggtgtttggtgagggcctgttccctggtcgatggtgccttctcactgtgtccttacatggtgaagaggcaaggcagctctctggggtccctttcctaaggacagcaatcccactcctgagggctccaccctcataacttaaccacacctcaaaggccccatcgcctgatacgtcatgttgagggttaggatttcagcgtatggattttggggcacacaaacattcagaccatagaaatgggagaagaagagtaagacagagagaaaagtaggcagaactactcattaagagtgaggtggaaggtggagagggcagggagaccttatgaagatcacacatctgtgaggaaggtttgcacactctcactgaagccccggtaggaggctcagcacccatttctctagatagcaccttccttcctctgaggacagattctgactggagccctggtagggggctcagcacccatccctctagatggcacctgccttactctgaggacagactctcactgaagccccggtaggaggctcagcacccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctctgaggacagactctgattggagccctggcagggggctcagcacccatccctctagatggcacctgccttactctgaggacagactctcactgaagccccggtaggaggctcagcaaccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctcaggacagactctgactggaaccctggtagggggctcagcacccatccctctagatggcacctgccttactctgaggacagactctgacgggagccctggtagggggctcagcacccatccctctagatggcacctgccttactctgaggacagactctgactggagccctggtagggggctcagcacccatctttctagatggcagctgccttactctgagggcaggagcttgctttgtatgttccagtcccttctgagaaccagaagcctgagcatctattagaaatgcaggattgtggacccaatcttagacctagagagctagactttgcatttgaatgagagctacaggtgattcaaaggtgactgcatgtgtgggtgcagtggctcttgcctgtaatcctaggttttgggaggccaagatggggggattgcttgaagccaggaattcaagtcctacctgagcagcaaagtgagagcacctctctacagaaaaacaaaagcaaaaatgtgactgcatgttggagccacctggctttttttaaataaaaaagatccatatagctggacacagtgactcgtgcctgtaacctcagctactcgggaggctgaggcaagaggattgcttgagcccaggagtttgaggctgcagtgagctatgatcatggcactgcattccagcttgggtttcatctgaaaaaaaatttaaaaaattcatctagttccacctcagagcttctgattttatttccatggatgtggcctgggcttgcgattttctttttcttttttttttttttgagatgaagtcttgctctgttgcccaggctggagtgctgtggcatgatcttggctcactgcaacttccacctcccaggttcaagtgattctcctgcctcagcctccctaatagctgggatgacaggctcgtgccaccacacccaattaatttttgtatttttagtagagagagggtttcaccatgttggccaggctgatcttgaactcctgacctcaggtgatctgcccgcctcggcctcccaaagtgctgggattacaggtgtgagccaccatgcccagcctggcctgaggatttttgtgagcactcctgatgctgttgtgtagccaggagtgaggactgccctctgatcacccagcacagaacgttcagggccatgttgggacagtggactggtaagggcgagaggaggacactggggagcaggctgtagggtgccacagtccgccacagtcacaggctcatgctctccgtccgagaggaggcagaactgcttttaccaaggctcatccagccctcttcatttctctgggaacaatttttggtttcgtgacccatttcttaatccccggaaggcatttctctgaactggtgccaggcaccccggcccccagctccagttagttattattcgaggctgatttcttttctgtctgtcttccttctaattcctagattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggtgagtccccgtgcatgtgatctgtgtgagtgcaagttcatatgagagagagagagagaaacagactggagaaagatcttcaggaccaggttgctggtgtggtttctttcttttctttttctttttttctttttttgaggcagagttttgctcttattgcccaggctggagtgcaatgccgtgacctcggctcactgcaatctctgcctcctgggttcaagtgattctcctgcctcagcctcctgagtagctgggattacaggcacccaccaccatacccagctaattttttgtatttttagtagagatggggtttcatcatgttgtccaggctagtctcgaagtcctgacctcaggtgatccgcccgcctcggcctcccaaaatgctgggattacaggcatgagccaccgcacccggccggtggtgtggtttctgctgtaacaaagtgccacagactgaatggcttcaacaacaaaaattcattttcttgcagttctgaggccgaaagtctaagatcaaggtgtcagcagggttggtttcttctgaggccgccctccttggtttgtagatgcccccttctccctgtgtactgatgccatcttgccttggggggaagagtggcctagtctcctcttcttacagggacagcagtcctgatggattaggcacagtcaggcatgactacacaagacctaatgttaatctagtcactcctttaaagaccccatttcccaaaacagccacattatgaggtcttgaggattagggcttcaacatgtaaatttttgggggggcacagttcagcccagaacaagtgagaaggtagaatgggttggaggccagctggggaagttttgtgtggggaagaatgaatgaggaactaaaaaaaaagtcatttcttgaaacaaccatgatgctcgatatattccatttcctcatgggccatgttcatagatgagagttggagaatttgccatttacaacaatggcaacctcacctaaaaactatgaaaatactttttttttttttctttgagacaggacctctctctgtcacccaggctggagtgtgtgatcacagcttactgcagcctcgacctcccaggctcaagcaatcctcccacctcagctcccccgagtagctgggactacaggcatgcaccaccatgctggctaatttttgtattttttttgtagagatgtggtctcatcacgttgcccagcctggtcagaatgctttgtatgggttgaaatgtcacagggaatctcctgtgactttattaataatgtgcttgctcacacctgtagtcccagctactcgggaggctgaggcaggagaactgtgtgtacccgggaggcggagatggcagtgagccgagatcgtgccattgcactccagcctgggtgacagagcgagattccatttcaaaataataataataataataataataaaaaatgtgcttgctttctcccacaccatgaatcagattcacacgccccaccgcgctggtgcctgggccgcctcactagctctgtttcattccctgctctgtggacgcatgcaggcgtctgcatttttgaggagctgcacagcaagtgttaaagtccgccactctaggacattttgctacctccctctccggctcaacacactcaccttgtcaccagtcttatcaatttttcctcctacccgagctgttttccacttttcctcgtcctcaccccaccagcccaggtccagcaactgtcaccacttgcctggacacgcagtgacctcctagaccatcagctccccggggatggggtttgcgtttgtttgtcttgctgtcatctttgccacgcctggacagacatcttagtacccatcagtggtcaaaagcacgcactgaatgaatgttggctctttggtctccctgtgtctgcctttttccctcacccgaccattctctgcacaaaagtaagatggtcctttagaaaattctgattcgattgtgctgttcggtggcttaaatgctttctgtctgctctgctctttattttttactttatgtatttatttttgtagatgtagggggcgcaagagcagctttgtttcatggatatgttactgcacagtggtagtgtctgggcttttactgtaactacccctttttttttgagatggactctcgccgtgttgcccaggctggagtacagtggagtgatctcggctcactgcaacatccacctcctgggttcaagcaattcttcgagtagttgggattacaggcatgggccaccacgcccagctgatttttgtatttttagtagggacaaggtttcaccgtattggctaggctggtctcaaactcctgacctcgtgatccacccgcctcggcctcccaaagtgctgggattacaggcgtgagccaccgtgcccggccttagtgtaactcttacccaaatagtgaacattgtacccaataaataattttccagccctcacctggctcccaccctcccacccttctgaggctctagtgtctatcattccatgctctatggatgttaccctttgtttagctcccacttgtaagtgagaacgtgtggtatttgactctgtttctgagttgtttcacttaaggtaatggcctccagttccatctgtgtggcttcaaagatgtgacttcattcttttctatggctgagcagtattccattatgtatatagatcacactcttcatctttgctcttttggtaaatttcaaatcgtagtgccatggagactggttgtttgggacatttaaccttatttctccaacttcatgcccaaattctctccccactgccattgcccctgtatgattctggagaggcagacacaaacagggaagggtaggggacagtgagatgcttcgcagagaagtagagatccatttgtccatttgcttgaagttggtgtaaggatagggacagaaaggaaggtggtctaacaggctccaggacctatgaactattgccctggaaagaagctagaatgttgttcttgcccccatgacagggataaagtatagtttttgttgctggtggtggtggtgacggtggtagtgatgtgcgtgtgtgtttgtgtgcatgtgtgtgacggggaaactaatcaagaatcagagctgcagcgggatgtggaatcccagcactttgagaggctgaggtgggcagatcacctgagcccaggagttcaaaaccagcctgagcaagctggtgagaccttgtctttagaagataataataataataaaaataaaatataaataaaataaaatggctaagcatggtagcacatgcctgtatttgcagccacttgggaggctgaggcaggtggatcccttgagcccaggagttcgaggtggcagtgagctatgatctcgccagtgcactccagcctgtgcaacaaagtgagaccctgtctttaaaaaaagaaaagaaaagaaaagaaaaagaatcagagctgcttttcctttcaatatagatggagggctgggatgaaatcgtcaaacacaatggggtgacaatgttggtgaagacaagaaatagctgagtgcagcactggcgagggcagtgccgactgcgggcacgtcaatggttaggaacacgagggaaggaggtgggtgcacaggcccacaccgcccgcttcacttacaaaccaggagcgcaccattcacatgtctggggggtgatctcaatgcacccggcactgtttacggccgggagttcactgacaggtgatccctctgctgtgactggggagactgggggctgacctcccaatgtgccttgtgctgtattccggagctctctggtcaggtgtattctgatgctttctctattccagagctctctggtcaggtgtgtcctgatgctttctctattccagagctctctggtcaggtgtgtcctgatgctttctctattccggagctctctggtcaggtgtgtcctgatgctttctctattccggagctctctggtcaggtgtgtcctgatgcattctctattccagagctctctggtcaggtgtgtcctgatgctttctctattccagagctctcttgtcaggtgtgtcctgatgctttctctattctggagctctctggtcagatgtgttctgatgctttctctattccggagctctctggtcaggtgtgttctgatgctttctgtattccggagctctctgatcagatgtgttctgatgctttctctattccggagcttcctgatcaggtgtgtcctgatgcttcctctgttctggagctctctggtcaggtgtgttctgatgctttctgcctctgttcttggcatgaaggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggtgagtcgagcccgttcccctaaggaagttctgccagcgaggcgtgctgcgcactctggcttcagtgaggcccggtgggctggggtttgagtgagaatggccttggcggctcgggtgactgcgtgtgcttgtcttggggtgtctagcattgcggtcagtgagtgtttgtcgtggggaaagccacacactcaaccctgacaaggagcataaataataacaaaaagaagatgtctgcctttagggtgcctactgcctagctgacaaaaagaaaaaatcagtgtaatgcattgctttagaggagttttagaacttcatgacaagccctgggtcctcatattgtataagaaaaatggtgctaaagcaatgcagaccctcgatgttgtatgcagcccttccctgagtgcttctgggagacttgcattttgaaggagagaaaaaaccacttaaaaatggaagggccatttctcacccattaggatggctattatcaaacaaaagcaagaaaactagaaaacaacaagtattggtgtgggtgcggagaaatggaagccattgtgtgttgctggtgggaatgtaaatgatgcagccactatggaaaacagcacagcaattcctaaaaaataaatacagaattactactggagccagcatttccactgctgggtatatctgcaaaagagttcaaagcaggaactcagccaggagcggtggctcacacctgtaatcccagcattttgggaggctgaggcaggtggatcactggaggtcgggagttcgagactagcctggccatcatagtaaaaccttgtctctactaaaaatacaaaaattagccaggcatggtggtgcatgcctgtaatcccagttactcggggtggaggcaagagaatcttttgaacctgggaggcgggggttgcagtgagtcaagatcccgtcactgtactcccgcctgggtgacagaggaagcattaaaaaaaacagaaggcaggaactcaaacatgttatttgtacatctatgtccatagcaacactattagaaatagccaaaaggtggaaataaccaaacgtccttcaacggatgaagggtgttgaaaagtgctatatatgtacattcagctttaaaaagaattctagtacacactacaacatggatgagcctcggggacattatgctaagtaagataagctagactcgaaagggcaaatactctgattgtccttataggaggtgtctagaacagacagattcatagagacaggaagaaacgtggttgcaggcaatgggagggcggagagtgggaagacattgtttaatggttatggagtttcagttctgcaagatgaaaggagttctggagatggtggtggtgatggttgcacaacaatgtgaagtgcttaaggccattaattgtgcacttaaaaatggttaaaatggtaaattttattttacacgtattttaccacaataaagctgaatgtagggagctgggaagatgtagtattggtgggagcttggagaatgcttacttgttattccaccaaatggaaaaggaaatcagaagtgtacatagagcttgtgtccactccctttccatgtgtaaactggagtagaggcagtggcaggtacgggtgcttccttgtccatggtggagcgtgggtgagagacatgactgacattctgccatctctatggaaggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggtaagtcttcatgggtgtcttaccagaaaagtaacttcttttcagaggtgaattatttggaaaatgtggatgggggttactttggtcaggcagagctgaaggtagagtaaggaggtaaaaacatcagaaatgctttgaaggactggaggcatataatgtatactgctgctaataagataatttatgctaatttatgattatagaactagagtttcttagtgttggaagaaaccttagagatggtgcagcccaattgcctgttgagggaaaaacttgcttccaagacactcacatgaatagtcacccattttatgtgtgcatgcttgcaagcatgcaagttatcgcatagtgcatgcagcctctacactaggaaagagctctcaccctgcagcctctacactaggagaggactcttacactgcagcctctatatcctcaacagtgtcatggctcagcaccttcacctatgtagccatgctctcccaggtacacaggctggtttgttagtgtctgtctttgaaatgtggtgcccagacctgatgatgcatggtggatgttttacctcctgttgcagagaactatggtttcactggtggaatctctgatttccttgttttttttggcagttacataagccttttgattcatgttggaattctgcagtaaacagtagtagggaatacccactaataatcatgcactttccctgtaccactttcctgtatcactttccctgtatcacctgctctttcatgttcttacatggattttctcagttggcttcagaaagatgctatagggtagggtatctgtgtctccaatttaaagaggagaaaataaaattcagggagcctcataactttgtccaaggacactcagagagaaggtagtggaactcagtgtagacaaacgtctgtgacctcccaagccactgccttaattcccagtgcattgccttaggagatgttgctaatgggctctctacagggcttcttcatctggctctcagcttaagggtgggacctccaatttagctttgctaaacctcatcttacctgtcttttgacccattgactaggcagttttgaatcttcattctgacaataatatctacaaatacaataagcaaattggataggtcttcattcattcacattattaatatatataccagccagatcagcattcaagacaaaatttggcaggaaaggtcttcccagaggagtaatccactaatccataattaacaaccaacctctgttcacaaagctctgatacttccttggacctctcccatcagccaatcctcagatgtgaccatatctctttctatgaagtcttcctgcagtgccttcatttcctcgccttagggtattacccttccttagcaaatcgccttagaatattactcttccttggcaatttgacttctgcttctctaagtttgttcaacagacatgattttgtcccttcattttgcaggccctctgggggctctgtggtgggcactgacagcagcagtgagtaaaacagaccaaaatcctgttttcacaaccgttcttttagggaagtgataacagataatagacatgctaaacaatataccctgtgtataagagctataagaaaaactggagtgacggcgaggggtgcttctctgctcacgtttggcgagtgcctctccgagcgggtgacattggagcaggtgctcagtgaagcgtgggatgggctgtgaaggagccggaagagccctccaggcaaagcagatggaaccgaagaggcccaggcgtaggcactcaggtgactctcagtgatcctggttccaaattccacatgacaaacaagccaattacaaatgtgcctgatgcatctgtaatatgctctatgtagttactattgtcaatacctaacctggtagagctgctgtaataaagtatcacaaacagagcggcctaaacaacaagagtttattgcctctcagttcaggaggccaaagtctgagactgaggcatcagcaggctgggtccttataggtcgtacaggtccttcccagtccttactttagttgacatctgctgcctttaattcatttcactcttcctctttggaagccttcttcgctcttatttttaggtcactacttagtctttcctgctaatgttatagcttccccctccctggatcctgcattggcttctcttcctgtggtctggggatttcacgactggtttagttgtgtttttttttttttttttttttttgagttggagtcttactctgtcacccaggctaaaatgcagtggcgcaatcttggctcactgcaacctctgcctcccgggttccaacaattcttctgcctcagccttctgagtagcagggactacaggtgtgcactgccatgcctggctaatttttgtatttttagtagatacggggtttcaccatgtttgccaggctggtctcgaatttctgacctcaggtgatctgcctgccttggcctcccaaagtgttgggattacaggcgtgagccacacacccgcctggtttaccttttttgttgttgttgttactaaatatttctaaactccctgagaattctcatatacctctcaatttcaacaacagtaggtctcaaacccagatatcattcacaaactttttattagaaaagtaacacatgcttggtgtaaacatatcatagtacagacaaagtggaaagtgaaagctccttctcagccctcttctgagagagccatttacaatagtctgatgaacaaccatccagactttttttaatacaatagattgttatataatccattcatctgtccatccatccatccatccatcatccatccctctattttccatccgtcaatccatccatccatccatccatccatccatccatccatccatcaatccatccaagggagtatcagagctttgtgaacatatattggttgctaattatggacaaatggatttcctgtatatgctgatctgggtggtatttatatcagtaatgtgaatgaagacctatgtgattttcatgttgcatttgtaatacattgttatgtagtattttaaatgcctagtctgttagagctactgtaataaagtatcacaaacagagcagcttaaacaacagaaatttattgtccctcagttctggaggccagaagtgtgagattaagatgctagcaggctgggtccttctgagggctgtggggaatctgttcatgcttctctttggcttctggtggaatgtcatcttgctgacacattttgccattccttgacctgtagatgcctctgccacaccattgcctttatctctacgtggtgtcttccctgtgtctgtgtgtgtctttctccatgtcccaagtttccctgtgaaagaacacaagtcatgttagatttgtaacgacctgatcttaactaattacattttcagtaaccgtatcaccaaataaggtcacaatctgaagtactggggcctaggacttccacatataaagtcttagaggaaacaattcaatccataacaccctatctattgaaactagaaccataatataaatatttttctgtgatatccttttttcatttatcatggataaatttccatgctgatttgtgtagatctatcgattggggcataatatcccatagtgtgctttaccataatttatttaatcaaatcatgcattttgggataactgttcttttccactattacaaacaactctgcaaaaagcacatttgtatatatagttttatgcatgtgtatttgctttgagataggtatctataagtggcattaatcagtcgagacttttatgcattttatgtgttaggtacagccatacatgtggctgtgtgttaggtatagcctatgggttaggcatagcctgtgtgttaggtatagcctatgggttaggtatagcctacgtgttaggtatagcctatgtgttaggtatagcctatgtgttaggtatagctacatttttttctctcgaactttgggtcctcatctctggctgcatattgtgtactgcctgtctcaatactgctcaagggtcacacatgctgagcatttgcaacattggtttaattatcataccccaccttccacccccgttctctgacctgctcctgccctcttcctcctgcctcattgaatagtggggctttccaggaggctgctgagtgagtaaacgggggacggtcctaaatgctctgctttcggttccctctaccactcatcactacaccagagggaactttttaagatgcaaatttgaaaatattgaccctttgttcaaaaatcttcaaaagttcttctctgcagtcagagtgacatcttagcttggcacacaaggctgtccctgatactgccctctctcctgccataccttgcactccattttgagtcatattggatgagttttgttttgctgttttagagatggggacttgctatgatgctcaggctgaatttgaattcctgggttcatctacagccataccacccagagtgcctgatctcatctgcactcctgggctcaagcaatcctcccgtctcagccgcccaagtagctgggactataggtggacatcactgtgcccagctatgaattagttttgaaacatcttggtggttcttttaatcttccttattcttgctactcttttccttttgcctggaaggttacccccactttcccactttctactatccatctaagaagctcctacttattttttaattactgtgatcctcattttgtccatttaaaagcagggataaaactaacattcccatcttgaggttgtgatcattcaatgagataaccctgtttaaagtcgtcatccatgtcaagcacacaataaatactcaaaaaatgtttgatcttcttcttcagattccttccttccttccttccttcttcctcctcctcctttctttctctctttttctttttctctttctttctttctttctctctctctctctttctttctttctctttctcccttcccttcccctcccccccccctttccctttcccctttcctttccttattttcctttcttttcttttctttttttaagacagggttttgctctgtggctcagactggagtgcagtggtaggatcatagctcactgtagccttgaactctcctgggctcaagcaatcttcctgcctcagccttctgactagctaggactacaggtgtgtactaccatgcctgggtaatgtttaaaatgtttaaaattttttatgtagagacagggtcttgctatgttgcccaggctggtctcaaactcctggcctcaagtggtcctcccaccttggcctcccaaagcactgggattcagttttcattatgagacagttttgtgacataggcaggtagttaataaataaaaatccccaaccaattaacttaatacagtacatggcaagatatccgtgcttggtaaatgtagagctcagttaggtggattggttgaaatcgagatgtcaatcacattcctctaatccaaggattggttggtgggacatggttgtttgattctttaaacattttattatgtgttcagtgtaaccgttgcttaatagttaccagcattttcacaatttggatatgacgttttcttaacaaaactgcaccgtctgttgcaatttctactactactgtgtagtgctccccaaacatctgttgaataatccattctactcctttttggaaatagtggtaaagcctgcataactttaattacataatttaaaaaatattttctcttttcctctttgaagaccatccccattctactagaatgtccctggcctttgccaggaatgctactaatcccttctgcatgttaattaacaacaaccctctgatagaattcttaccggggatgagagcttagtagaagccactcaaaacttgctttgtttttgtctgtctctcttgggcttcatttgcctattagtcttacttactgtgtcttttcagtttgactcttccttaattgggaagatagaaaccagtggatggataatcactttttcctgctggtcatctgttcatgctttactgtctgaatacactttttctgtatttctatttttcctgcctcgtagacaccaaagagcttaaaaaacatgccattgccaaggactctggcaggaaggaggcaatcacctgcgctattcctggcttcatggaatagaagcatctgtgctcctaggaattacgccaccagtgattttagagctcttatgctcttcctgggtgatagaatgggcttaatttgactcaagaatagtacatcaaaactcttaattccatcgagattgatgcatttttggggttttatgctctaaaaggccttttgctgtgcagaaggaagagagaggtggacagaaagggcagtggggagaagatgagactaaaaggtggaaagtccaggtctggatccctccccaccacacacctgctctgtggccttgagagaaacatgtaatttttataagccttagatttctaatatgtaaaatgtatgtaatagttttagctgcactccttccttgccaggttgatataataatcaaataagactggtctctgggtcaggcacagtggctcatgcctgtaatcccagcactttgggaggccaaggtgggtggattgtctgagcccaggagtttaagactgcagtgagctgtgcacttggcctgggtgactgagcaagagcctggctttttctatttatttatttatttttgagacagagtctcactttgttgcccaggttgaagtgcagtggcaatctcggctcactgcaacctctgcctcccaggttcaagcaattctcctgcctcagcctcccaagtagctgggattacaggtgcccaccaccaccctaactaatttttatatttttagtagagatgggctttcaccatgttggccaggctggttttgaactcctgacctcgtgatccaccctcccaaagtgctggacctcccaaagtgctgggattacaggcataagccactgcacctggccttatttatttatttatttaggcagggtctcactctgtcacccaggctagagtgtggcagcgcaatcatggctcactgcagcctcgacttcctggactcaagcgatcctcccacctctccaacgtggttgagggctgcagcgagaaagatgtgaaaggggcatttgggggcgcaggaaggcgggaggtggcaattgctaagggccccgccgtgttcctgtcacagccctagctacagcttagaaggtcacaatggacgttcacctgttgtctttgatgtttaaatcagcaccgacttcccatgaggaggatttttttttcctgtctctcttaaaaaaaaaaaaaaaggcccctgcagtgtgggtgtctgcagtgttacggggattattagttgaggataaccactgggatgtgtttctggaagaagtggtgctgaggagcactcctggccggaggaaagctgtgtgaggaggaggaggagtatggggtaactggctcagtttgccttggctctttctgtcggactcatacagcaaagcatctgctgagacatcatttgtgtctcctgtgacagccagagacagcaggtcttgctctccccagatcatatctgagatgctggctcctgctctctgagctgaaggctgcagctgctgagagaggacgaggcactgagtcaaagcagctgcacaatgttggggaacagctgggtactgaggactcttctccctgtccttctacaggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggagtaagtcctttggtttattacagcaatgagaacacatggtggccaagggtggagggacgtttaggcagagtggccacaagataatctgtatcttagaagtgaggtgtcttcttagtgtttgccttgttacaggatcatgggactgggaggagtccttccagatgatatagatgtaggaacttgagtccttaccatcacagttttctgtaccacaaaacaaggagggcagtatgacacttacattttatggaaatgtagggaaaggcacagaatttggtaaatcaatgaacaaaccactgttactaatttgatctgtgcaatgcagtggatttgaaaaagagagagaagaataattaccagcatacaaggctgcttgaagctagttagtcctgtgctcctgtgctttttttttttccacctgaaacaagacaggctaagatgctaaaatcttggggagctagggggatggttaaggggacattttctttaaatcaccccctttttgcagattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggtgagtgtgctctgcagagatgcccgtggtgggactctgagttctcaggaaacgttgactgttatcaaaatccaggatggctctcgcttcatttgcagccactcaagattaggttgggcctgggtcagttgtggtggatattttaaaatagagaatatggggttaaactacacattccacttcactgagatggttagaatcaccaaggctaagctggatttcacccacattccccaaagaaacacaagccctcatgcgatcatggccaaggaggattctgttctacacaaggaaccgaacttcgtagaactcgtctatgggtcatccaaattggaagggtctttacatagtggggatcttgttgttttgtttctgaggatttattttttttttccttgagacagagtcttgctctgtcgcccaggctggagtgcagtggcatgatctcggctcactgcaagctccgcctcccgggttcacgccattctcctgcctcggcctcccaagtagctgggaccacaggcgcctgccaccacacccggctaattttttgtatttttagtagagttggggtttcactgtgttagccaggatggtctccatctcctgacctcgtgatctgcctgcctcggcctccccaagtgctgggattacaggtgtgagcctccgtgcctggcggtttctgaggatttctaaatgggaaaagagtgctccaggaatagcaagatgggaaattacacgaaattcgacagtgtgtcaggatattgccagcccacctctgtgatactactgaggtagtcgtctcctctctagcaagagcttcctggcgagtcccacggttctgtcagccgtgatgattgcacttttccctgaagacgttttcactgcttggctttaaggccaacatgctctcctgggttttctcctatttcatcagatccttctactcagtctcctttctggcctcttcttcatcatcctgacccttatgtgttgaatcctcagagcttagtcgctgggctaatttttcttccctacactttctccctcatttaaattatctggtcttctggcttcatgatatgtgtgctgtggcctccagattatatgtccataaattctgtgtctccgtgcttggctgatctttcttcttgaaggtttaataaacctctcaaacgtcacatctagatccacacccttgctactctcttctacccgaaacctgattcttccccatttcagtcgatggtcacttcctccaagttgctcgggccaaaacatttctggttctgtcgtcactgtctctttttccttataatcatgtccaatgtgtcagcacatcctgtgagctctgccttcccagcttggccactccctgaccacttcaggccagcttcacggcttcttccttggctcaagccaccatcacctggtgtctggattgtcatggtggcattctgacaggtcaccctgcatctgttattctgattttagcagacaagggattcagctaaaacgtaactcgcatcatatcactcttgtcaacatcgtcttcttatcactttcataatcagagcaacaaactcatggtggcttccatgccccacataatccagcctctcctgcttccgaagattccgcttctcccaacccttgcttattctgccccagtacagtgatctccttgctgttttgcaagaacactgtcatctctggatttttgcacttgcttttcttctggcctagaactctctccccttcagtatccacctgcattattccctgtaccttcctaaattctctgcttaaaggtcttctctgcgaggctgtctttgactattctactgaaaatagaagcactttttcttctcttctcattctcctctgcagtgtagcacatcttatgtgctatgtcattttcttgtttatttattatctatctctgctcccaaaatataaattccattagtccagggacttctgtccatattaatgatctcaaggctgagaacttgttggaatgcaggtttgaataaatacaagtttgaatcagccttgcatccttgtgccaacataatggagcacatttgctgcaggacaagccaatattcccagagctaagagagatgggggaacaaacaaaggattggtcaggtcaaagctggggacactgctacatgtagcatcactgacctagccctgagggacattctggacccaggctgagggacaggctcaaaatagattgaagaatccatgaatgcaatcaacccgttttctcaggctgcgataacaagctgctttagactgtgtgactcaaacacagatttattatctcacaatactggaggctagaaagtccaaaatcaagtctctgatgaatttggttgctggcgagagtcctcttcctgatttgcagatggctaccttcttgttatgtgattgcatggagggaggggaggcaagggagagaagacaggggagaaagaacaaactctctgatatctctcctgtaagggcactcaccccatactgagggccccaccctcacaacttcatctaactctaactacttcccaagggcctcacctttaagtaccgtacattaggggttcgggcttcatcatgggaattgttaaggaagacaaacattcagtatataacaccaccaaattgagatggttataaatggtgcaggacaaatgggtggatttattagttaagttgcaagggaaactttattaaagaggaggaagaacttacatcgaagatgtgagaggcatcctgggcaaatgcaatgtgtagaattgatcaggttagtgactaaatgaacataaggtaaaaaaatttacaagacagttgaggaagcgtaaatgctgactggacatacagtgatactaagaaattattgttaaacgattttggtgtgatagtgacattgtaattatattttagtgtcacaaagtgaattattgatagatgcattaaatgcagtatttaaaataatccatgggtgggaggagtgggtgggcaatagaagaaacaagttgacatgacctgtttaattgtcgaacttgggtaatggacacagggggttcattatactattttctatacttttatgtatgcttaacattttcccaactagatagttaaaaatataacaggaaccacattgggcacttagagcttttttttttttttccccacatttttattgggagccgtgggaggggcctcctctgtcattggaggtgctcacagtttcttcagccactccaggctggggtcctgggggtctgaggctcccagtgacgaaggacacgacgagcaccggctccttggcccaggcattcttgaagaaggtgcggagtctcgcggccatcttggtctcggcggcggcgacggcggcgaggacgcggagcactctgggagttgtggtccctcttttttttttttttttttttttacattttagaagtgtgtggagtttagggaaatgaagagatgagacttttaaggttaacgactctgacagagttatctgaagagtgcaacccaggctttctatttgcttttacaggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaa

SEQ ID NO: 1896 - DNA, 32949 bp, Homo sapiens; identical to SEQ ID NO: 1895

SEQ ID NO: 1897 - DNA, 31056 bp, Homo sapiens; identical to SEQ ID NO: 1892

SEQ ID NO: 1898 - DNA, 35938 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggtaagaggagcaggcattgtcccgtcccagcttgatcctcagccttctttcatccttggccgcgacatgctcccaggcctggggtcagatggggagtgctgactctgtttctgggctgttttctggggagaatgggtcggcgggtttttttccccaggacctgggcagggtcaatggtgggggccgctgtcgcatccttggctggtgtttccacagctgagaaccactccagggccaagcccagagcttattctacccttttttgtcctctcttcccctgtcctcggccaccccaccctcttggctcctctgcttagatgtgggcacaaggaggagaactccttggcctgagagaactaccttagatcctggcttccagtggcctctgcaggggggtacaccctctctcccaagcagccagacacacaagtaacctcattgcctcagtttccccatctgaccagcacagggccccctgtgccccagcagcgttctgagagattggagctttctccttttgcttaccttggctaccgtatgaggacggatacagagtgttccccccacccccagcccaggggatatttgattcatgaacattccctcagtgtctttgtgggggacaatgctgtgccaggctcagggatgccaggacgagtaagacccaggctcccacgtggcccaggcagggagagagacacataaacaaccatcaggaaagaggtaaaatccccaggccacttggcatctgctcccttgagtgtctgggaatgtccctgatttataaaaagaagctgacggccctctttgttgtccatgcctacaccctttcactttcgtttcttcggggcactgcagcagcccttgtccacagaccccatgacaatcgcagaactgaccatgctgagagattttcttggctgctcagggaccctgccagggcttgaagctcctggagggtcacttgccctcaaattcccagaacgcacagcaggtcactgatgatagcagtggcagcagtctgtgcacggtggtttcgagggcgtgggagggaggtgagggccctagggcaagtgtgtgtgggaagtgttgatgggggacaaggcaccagaacgctcggaaacaacttagtttgcaccgtaatttttcacttcgcctaggacaggacctttagagcaatattctgagtctaccccttggagtagcagtgtgcaaaacacacagcacgggcttggggcccccgtggggaacccaaatgtaagagttagagacatgcattccggagtcatacatggctcgtgttgaaatcctgactctgcctgtctagctgtgacacatcgtacaaatcacttagcttcttggtgcctcagtgtcttcctctgtagaatgggtagatcataggcactacttcagagtggctgggagggttcagtgaattcctgcaggagagcacttagaatggcacttggtgtgtagtttatgcttaattaatattagccgttactgaaactgctgtagcctgaatccagccagcatgaaagagcccctctcaccctgcttcgaagagaatgaattccctgattgtttggaagatctctctctctctctctgtcttttttttttttttttgagaaacggtcttgctctcttgcccaggctggagcgcaatggtgccatcttggctcactgcaacctctgcctcccgggttcaagtgattctcctgtctcagcctcctgagtagctgggattacaggcgctcgccaccacgcctggctaatttttgtatttttagtagagacagcgtttcaccgtgttggccgggctggtctagcgctcctgatctcaagtgaccttgggagatctcttgctcctaatattacctcaagcctttttaaacgttttaagccggagaccaagcatggatatgggagttaggggtcttgatttaattcttggttgcttcaaactctgtggaaccttgaggtgtttcttgccttctctgggtctcaattttcacatctatatggtggggagcttggattgggtaatgtctgaggctagaaccatggccaactcgggttctgctggggctgacttgccctggccttccctgaccaccctgcatctggcttctggagaagtcccgcactgaccttgttctcctccccaggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggtgaggcactcctggtgtgcatcacagagttctcaggaaaggggtgcttagtcaccaagactgatttgtcctcatgaagtcagcctgtggggtaacttggtccatgggatttcccctaaaaaggtagccaggcaggtaaaatttgctcttgactcttggcaggaaacgtacaactctttctttcttcttttcttttctttttctcactctgttaccctggctagaatgcagtggcacaatcatagctcactgtagccttgaattcctgcgctcaagtgatcttctggccttagagtagctgggactacggctgctgtaccaccatgaacagctaattttttttttttcttttagagatggggtgttgctatgttgcccaggctggtctccagctcctggctttaagcaatcctcccgccttggcctcccaaactgttgggattgcaggcatgagccactttgcctggccaacagaacacttctgccgagaggaagtgtgtggtggccaggaactcagattctggagccagaatggtgcaggctcaaggtcaaccctgtgtgatctcaggcttccctatggagcctctccagcctcagtctcccttgtttcagtttcctcatctacaaaacaatgttaatagtcaaatggtgcctatcctataaggctcttgggaggattcagtgagttaatttgagtaatgcttaggatagtgtctattaccactggctgctatttattatttctgttatgagtgatactctgtacttgtacacttttatttctgtctgttttaaattaacagcacaacagaccataacactgcagtatattgaatttattttataattaacatagcatattataaactaatatagcttaaatgtttatgtaggatttctgacatgaaattgcattagatcatagatgttcagagttggtatataacagcccctgagaatgtagtaactcagcagagaccagaaggtcagagaaatgaccactgagtatttttgaaactcttttgttttcttccaaatagtgattcttagggctcctgagaggcagatggaacaatcattaacattccactttataaatcgggaagttgagaccaaggaaagtagtttgaataagctcacagtagttaatgagggggccagtgctggaccaattggccagcactggtcattgacttattcatccatcattcatttattcagccagaatctattaggtgcttcatacatatttgcttaaagtttgttgtgttcatagagctttgcacacggtaggtactccataaacatttgttgatgaaataagtgagttactgaatgaatgattgaattagaatgacactgcagtgttaaaatgggctgggttggggaacattttagtttttgtttttgtctgttttccaaaaatgtatgtgttgttcacatgagtctggataaccctagattgagattgatgacataaataaatttgtcttcaaggctgcactaaagctggctcacatggctaggtatttacagagcagaagtggtgcagtcctctctgattagttgcacgtacagaagacatattcgttattggactgaccttagtttctcttataatttgttaggggaattgaatcagcccatctgagaagttacaagattgtgtcttgtcatctttaaaagttcagcaatgtgatgtggtacagatggtctgaggggtttggagaaggtagcctagatccctagggcccagagaagacaggatgtgaacagaggaagtacatggattggtgaagaaaagaaatgggataactcatgggtcaaagaagaaatcatgatggaaatcagaaaatattcagaaccatacaataatgagaatattatttatcaaaatctattggatgcagctaaagcaggacatagggggaaatttacaaccttaggtgcctagattaggaaagaaggaaggcatttgtttatttatttgtttatttatttatttgagatgggggtctcactgtgtcacccaggctgctggagtgcagtagcacgatcataaatcactgaagtctcgaacttctgggctgaagtgatcctcccgcctcagccttccaagtaggtgggacacaggctagcaccaccataccaggctaattttttttttgtagacacagggtcttgctatgttgaggtctcaaactcctgggctcaagtaatcctcctccctcggcttcccaaagtgctgggattacaggcatgagccactgcgcccatctaaggctgaattttaatgagctaagaattcatcttaagaaagggctaaatagacagcaaaagcaaacattgaaggttgggactgagctgagtgggtagcagggatgggagacaacagatctgaggagagcaggagattttgaaaggattgcactgcctgaggtttaagcctttagaatccagctctctctgagctccctttgagctctgacattctgtgactctgatttggtggccttcccttagtggccttactgatttcatttggatggtgcttgtggtatatccaaccaacatgtcttcccaaatggccttttaatttcctataaagaagtagttgtcattgattgcaggttagggacagaaaatgctgtggaatgaaacaaaatgcaagttaaagaactaaattccaaaaatacccattgctactattgactgagtgaattcctactgtgtgccagacactgtacccagtccattccctgtattgttttatttaagcctcacaagggtatagtgtgactacactgtttcttaacaatgaagaaactgcccaaatcgcccatctgggaagcggcccagctagaatttgaatccaggcctgttttcctccagagcttgtgctattctctgtctgtcataaaatgtgggggctttgtgtggtaaacttgctcagttgggcatagcagttgttaggaaacctgaggctggtaacaccagctgtaataccagctgtccgtctgactcatgcaactgttaaagttgatagggctgaggtgtcagactgagctctgaattgcctgattcctataacaatattaacttaaacattttttaaattgggaaatgcaccatgcatacagaagagtgtgtatatttcatatgtatagtgtaaactgttcccatcacccaggttaaaaaacaggatgttgccagtacctggggccttctttaactgcaactgctagaggtaaacactggcttgacttttgtgtaaatcatctctttgcctttctttaatgttttagcatcttttaaaataaatccccaaataatgtattgttctattttgaaaaactgagtagcaagccaaaaatagctgtgtaaagaaaggtcacttaaattaggctgggtgcagtggctcaagcctttaatcccagtactttgggaggctgaggcaggtggatcacaaggtcaggagatcgagaccatcctggccaacatggagaaaccccgtctctactaaaaatacaaaaaattagccaagaatagtggcatgtgcctgtagtcccagctactcgggaggctgaggcaggagaatcgcttgaacccgggaggcagatgttgcagtgagccgagatcgcactgcttgaacccgggaggcagaggttgcagtgagccaagatcgcaccactgcactctagcctgggtcacagagcaagactctgtctcaaaaaaaaaaaaaaaaaaaagaaaggttactattgccttttcttagatgaaggttcccaaggcagggaaagctaagtggagtctcagggacttggtctggcttttccttccctgggaatttataaggacctcttctgggaagtcagtcggcaatgccatgaatgagtctggggaaatattgggctcattgcaactggagggtctggtaggactgatgtgaattaggtgctgtgtccggaggaaaatggccagaggaagtgggctgctttgtacagtcagtggtaaagttgccaaaggctattatagctcacaggaatgggccaaggctaaacactcctgtggagtgaaatgaatgtcctcagctgactgaggcagcgggagttgaaaagaaacgatattagttcatggtgaagacaagtcaaatatagataaaggttagggtcaggcttgcctggacatctaggagataactgccctcaacttgtttgaatcttgagtcactgctccattttgtttgaactggtggccatctacttatagtatacagccatcaacctgagatttccctacatggtcttcctgccttggtctcctgtatcctgaatcctatggcctcttcttccctggtttactacattttgctagaccgtatcctccagtcaattccttagaatgaatgtatgaaagttaaaatttctgaggtctcacatgtcttaaagttccctcatactggattgatagtttggctgggtataaaattctgggctggccatcattttccttcagaattttgattgcattattccattatcctctcttttcaatattgcttctaagaattccaaaacctttttttttttttctttttgagacagtgtctcactctgtcacccaggctggaatgcagtagtgtgatctcagctcactgcaacctccacctcctgggtttaagtgattcttcttcctcagcctcctgagcagctgggattacaggcacccaccaccacaccctttagtagagatggggttttgctatgttggccaggctggtcttgaacttctgactttaggtgatctgcctacttcggcctcccaaagtgctgggattaaaggcgtgagccaccacacccagcctccaaaaccattttaaaactctttctggaagcttttaaaattttcttttagtccccagaattttaaaatttcaattatgtgccttggtgttcttccattatgttagtcacccaagaggtactttcaatctggaaacttctctatgttttgggaaatgttcttgattagtttacaggtgatttcttcctctccattttatctcttctcttttcatgaaactactattaattcaatgttagaattccttgactgatcatttaattttcttctattttccatctctgtgtctttttgctctacttttctatgatagtcacagctctatctttaaactcttgagtttttcatttttgatgtcatgattttaatttgcaaggggtaggtttgactgattcttttttgtagtatcttactcttgttttatggatgcaacatcttctttgacttaaggatcataagataggtgggttctttgtttgtttgtttgactgtttttcaccctatgtaaactttttctacaagtttctttccccttcccccctttttggcttctatctcccacattagatgctttctctgggctcatgatactctttggttttctttctcaagattgacaggtaggactttaaaacttgttgagcatgcgggtgaaacttgtctaccatgaatttcactgtagatattttggagattgacagtgtttatatctttagatctcgcctcctgggttgatcaagttatctgagtacaccacagaccttttgcctggggataaaccagaaatctgtttcagaaaccactttgattcagtcttccttgttttagtcatttccttcagttccggaggtccctcatgctgatcattccagagccctttacagatcctagggtacacactgcatggttttcaactttcttgttttggggttaagatttggctttcaggagtctcctcagtccgttactattcattcaatcagcaagtccttgagcacctgatttgtgccagacattcttctaggtgttagggatacctcagtgaacaaaacagacaaaaatctttgtcttggaaatacacacactccagtcaggggagagggacaataagccaaaggaaggaaattacagcgtgtgctagaaggtgataagtgctgtagaaagtaagtaaagtgggtttgggagttgagagtttgggaaggggataaatgatggcaattgtaaatagagtagtcagagttctcacttagaaggtgaaattcaagtaaagacttgaaggaggacagggaattagccacatggatggctaggggaaggcttccaagctgagaggacagccagagccaaggcccagaggcaggagcatacctggtagttttaggaaacaggaggccaggatgctgagtggagtaagagggggcatgaaaggagaaacttgggtccacgtggttctagacaggtatttttgtctgttttgggccctgaaggttactattggacttggactcttactctgaggaaatagggacgctattgggacgtttgtacaggagcaatgtgacctgagttttgtttgtaaaggattagactctggctgtggcattaaggctaggctgtgggggcaggaacagaagcagggggaccagttttgcagcctgtgcagctttccagataagcagggattgtggcttggaggaggatggtatagaggaggtgacaagaaatgactctatgtctggtatgtagatattggccacagatggcatttgagcactagagacctggctggtccacatggagtttccataagcacataatacacatcagatttcaaagacttaatatgaaagaaagaatgaaacgtaccttgctatttctttcttttttttttttttttgagacccagtcttgctctgtcacccaggctggagtgcagtggtgtgatctcggctcactgcaacctccgcctcccaggttcaagtgattctcctgcctcagcctcctgagtacctgggactacaggcacctgccaccacgcctggctaattttttgtatttttagtagtgatggggtttcaccatgttgtccaggctggtctggaactccggaccttaggggatctacccgccttggcctcccaaattgctgggattacaggcatgagccaccatgctcagccatatcttgctattttctacatggattacatgttgaaatggtaatgttttggctattgtggattaaatagaatatatgattaaagttgatttcatctatttcttttaactttaaaaaatatgtctgttagaggatttgaaattccacatgcggcttgcatttgtgacctgcatttcatttctgtggaacagtgccctttttgggacatgctttgaaggtggagtcaacaggatttggcagattacagacgagaggcttcaagggtgactccaagacttcggggcagagcacctggaagaaaggggttaatattagccaagatgaggaaggctgtcggtttggcaggtgcatgggcaggttaggagtttagttttgaatatgttggaggtgtttatgaaacttttaagtggagatggaaaataggcagttggatgtgcaagtccagggttcagggagacagttcaggctggagatgaagatgtgggagtctgaggagagattgtattcaaatattcaatccatgagacttgatgaaatcacttctcttccaaatgatttacagcctgcagaatcattttccctatctttgtaggtttatgtcttcattttgtttcatttatttttcagttattcactgttttagtgagttttgagtaggagccagattggatgcatgcgttcaattcaccatccaacactgtattaactacttgaaactcatgtggttgttcggttgtttttttgaccttttattctggatggaagagagatgcttatgaagttgcagtaatcagtaagccttcccacattgctccatcagccttcctggaagaataatgtcttctgcctttcctgtaggcaagaaggctgcttgatcttgccacggtgaaagcgaatggattggctgccttccttctacaacatgttcaggaattaccagtcccattggccctgcctttggaaggtaggtgtatgttctcagttaatcagaaagggaagggcagtcagtgcagatccatggttaagagcagaacacacctcggttaacatcccatatgctggcagtatagcctccctatgactcaatttccttgttttaaggctagcaccaccccgtctcattgggattttgggagcattaaaaggacaaaagcgtgtaatgttagctattagctttcattatctcccacacagtatactgacaattgggctaccatatattgagggctaactaaaggtgttacttaccatccaaactctcattatctgtaccgaaaagatatggacacatgttttgagttagggctggtatctcttgatctctgaaatttagcagctcacaatgggaaactcaagaaccaagtggatctagagactctggtatccctcagtgcccagggtcaccacccaaactcaggaacaggaggggcttggaccgcaccacttgaacataccaggcatcctgccaggtgctttatggacaatgtctaccctttgcaacaaccctgagaagtaggtggtgtttttttccaccttatagatgtggaaactgggcagggaggttaagtgacgagggaggggaagatgggtctgattgtaaattgtccccacctacactttctcttttcttgggagaagaaatgtcagttgtaaagagagagtgcaagcctggcactctttagggcttgttcctacaccactgtagggaaagctcattggcactgaagccccctgagctgtgtgtggtgctggcagatgggtctatcaccctgggctgtgtcctctgggcagcaagcaagcctgtgggcggggtggctggaagtctgtgcctggcactcgcgagtgcaccgtctcattgaagaacaggatctaaacatcagtgcgccacagcagggtgcgcggcacggagtgcaggccctggtttggcccttggttgaggtttgctgttgacatcatcaagcacagctagtcactgtaagaccaggccagggtgcaagattccccacacttctaaaggtgacaattggtgtgtttatttctctataaaatgacattttttttttctggagaattttagtatcattggtgatgactggaaaacctgcatcagaaatcaggtcggaagaggaagatatatatctgatatgtactggagaggaagatatctatcttatggtctaagttcagggatcctggtatattcagagggcagaaagctcagcaataatcatcaactctgggaacagaggtgacataaacacagggcgtcccctttgtgtgactgcagatagtcatcagtgagctcagagctctatgaaaattacttgctagtttttgggttgaaaatagtgggccagtgtttggttgggggcagtgaggctgtgatggcgggggaccatgccaagctcctaccagcctgggacgctaaaccagcacttccccatttcctgaaaggggaactaaactctgacacaggaaatggtttgcttgcattactttcaggatgagaaaggaagagcactggccttccaaacacaccccgtgcatgaaaactctccctgcatggggtgcatggggaggatggggaagtggaggcaggatcacagactcttgttcgagtgctcagctggggcaccccggtgaccccgaggccttcccttgctaggtccacccagatcaatcaggatcatctccccatctcgaagtttaactttatcacatctcagagttccttttgccacgtaaggtaacatattcacaggttctgagaatccggacatggacatctttgagggtctattgttgtgcctactatatccatgaataataatgataataagcaccattttttgagagtttgccatgtcagatattcttttaaactgtattttatctcgctgcctcctgaaaaaatccttccaggtgtatattgtccccatttttacagatgagagaactgaggcccagaaaggctaaatggcttgcccaagtgtatggtggacccaggttttcaaactcaggtgtgtctggcttcagagactgggctcctgagcccttaagccctttgttcccctttagaaaaagtcacctgaggctgagtggtgaagggatttatccaaagccacccggccactatggcaggacagatatcagaatacaggtcttccgatcccagcccagagccccttcccgtcatctagaactcctcctggtgtcagtaatgataacggcagtcactgatgtcttttgagcacttactttgtgttgagcacttacactgtgctaagcacttgacataggtcatcttagttgatccgtgtaaaactctgtgaggtagtgaccaacatttctcccaccttacagaggtggaaactgagggttaggaagtttccttgactgtcctcaaagtgcacagcttgtgaatggaggagccaggatgggcgcccgctggctctcctatcccttcagttatgtcagcgtcccccgcagcagcccattgtctggttaggtcccgtcttcaccatggtgccaccttcatctgcctcttcttctgccttccagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtagtgagtgttactgggcattgctgttcaggtatgggggagcaccatcaaggctaagtgtgggagcaccgagctgggctctagaagtctgggcccagcttcgcctctgccaccctgctttgcaacactgcccagatcccttcccttctgggccttaatttcaatatgtgatgatgacagccacactttattgactggcctatgtgctgggtctggtgctatgctttccggaatgacctcatctaatctctacaaccaccctggcgggtaggcaggaatgttattatctccattatccttgacttgaggctcagagaagtgaagtaacttgtccaggaaatggcagagctggggttcacaaattgcatcattctgattacaggttttctgcctcccaccagtctatggatacacttcagaggctccctgaaaaccttgaggtcacttgcagaaagttttgtgtagtatgtgtccgtatcaggaacaacaccaaatcagaggtgacttgtgccccatcagagactttaacaccccaaccagatgggaatttcaggacccaagaaatagaaagtggctgcagggttacaactactgttggattcctgaggtagcacagtgtccaaacaggatttcagcactacccgtattgcttagagccccagccaaagatgtgaggttttgccctttggagaatctgtgcccctgaactcgggggcctctttccacatcttgggggcaggcaagggcagagggtgtgcctaggcctgcggatcagcatgcgacagattccccaacatccttccagcttgaaaggggattgccctgcttctatttagaacctataggaaagcagaagttctagattgaagttaaaattgattcccagcctccaggggctttgggctacacctggatgaccttaattgaccctaagcatgggacaaaccacttcctgagagtattaggatggtatacatcttctctgggggcaaagcaacaagatttatttttcatcatggaccaaacacatggatacccactagaaactgtgtagtgaattttgttaaccctgacatagggaccatggtctttaggttaaagcataataacaacataatacataacatatatagcgaatatatatatgtattatatgcaatgaatgtaaatatgattatacccatcatggtcttggaggaaacagatgacacacttaaaatgggtgttttgaggagagtttgaaaaacagattgtttacaagccatgggcaggagttaggaagagtgagagggttggtgcaggggcctggggttagtaacagctgggggagggtagacttgaagggggaaggggagggagactaattagctggggggaaggtatggagacggctgcctgagcttctgcaaagtggaagaataccgcttggccctaactcctcaccccaactcttgctcctggccagcgccttccaccagctggacccatcagggaggccgagtgggctgtctgctggagtagtccccaggcatcagcctcccaggagccagggacgggtagagaagggggagagtggatctggccaggcaaatggaaaacagccagcaccaaactctatttccctaggagggaggatcatgatactttgagtgggaatttggaaacctgtctgttggagcaatttccctgatagaaataagaatgtgcattttcctgggtagtagactcagtttttaccccaagaggccaggcatcactggcctgtgtgatcctcataggccagtccatctctggaattcttgaatggatcatccatccttgattagggatgtccccgtgattaccagggtgtgcagaagggctctgggaaacctgtgggtctgtctctgtgttcagagaaaggtgagggtggcctggttctagctcatggtgctcagactgtggtgtgtaaaggcactcgtggcaatgcagattcctgggcctgcctctagtgattcccattcagtaggtttggggtggggcccaggaaatctatatttttcacagacacccctggtgattctgatacaagtggtctcgccctgggagaactactggtctgcagcaaccagcttggttttccattagcaattactgtccttgagcgagttttactgctcttcaccttacacacactaaaactgccaaggccgtaggggaggggaagcaaccatgaggttgctgtgagtgcactgtgtgtgtgtgtgtgtgtgtgtgtgtgtgtgtgtgtgtgtatgagagagagagagagattgagaaagagaggaagggaggaagggggagggcacaggctcctctcccacagtgccaacctgcctctctcccacttgaagtgtttccatgccaactgaaatcctcagcctctaggaaaccctatatacacagtgcccctatataggtttctttagactctggctctctcagactctagagtgatggctttaaaagttttttgaatgttacccacaatgattgagaaagagagagagagagcacgcaccaccatgtaaacatggaacctaagtttcacaaaatgacttcgctttatgaactctgagacactctgctctcttctgttctgttctatttccattttagaaatgctgctcaggaccttcaaaatgatttgcatgacctgcaacctgcagtctgaaaaatcactgcactacagaagtggccataagaggccctgagggagaagctgcacaatgtcatggttaagagtggggtttggagccaagccgcctaggctcaaagcctttatgtgccgtacaaccttggcaaagtcacttcgcttgtctgtgcctcagtttctttctcacgaatgctcataataatggttcccatttcactggcttgttgtgaggatgaaatagtgttattattgagaagtggtaagggtagtgatcagtgctagcgatcatgattctaggtgacttttactgtgtaccgggtgctcacaaggctttatgtgcacagcctggtgaggctgataatactattgttccctctttttttttttttgagacggagtctcgttctgttgcccaggcagggggtacagtggcacaatctcggctcatgcaagctctgcctcccgggttcacgccattctcctgcctcagcctcccaagtagctgggactacaggcgcctgccaccacgcccggctaatttttttgtatttttggtagcgacagggtttcactgtgttaaccaggatggtctcgatctcctgacctcgtgatccgcccgcctcggcctcccaaagtgctgggattacaggcgtgagccaccgtgcccggcctgttccctcttttatagatgaagagaccagcaaataactagtaagtcgctgatcaggatcacaatatccagctgaggcactccagagcctgagctgttaaccattcagtcagggcctcccaagtttgcctaaagataaagaatcatgtgcacagttgttaaaatatacagattcctgggccccaccccgcagatacttgattgccagctccagggtatgggcctgagaatctgtcttttagggaagctttcagatgatgttgtgatcaggtgagttttgggaatggtgccccaagaggagtggcagacagggcttgctcggcagggactagcctgttggagtggtgccattggggttaaggactgggcagcagggcctcactaaccacagcctatatgcctgtttctgaagttttggccactctcatccagctggtctactgtctgctgacctagatgatggtaaattgtccccaggggtagcctgtctagttcaggctgcacctttcgcatatatcagctcctttccaccatcatcccctttgtgaggctgctgtgattatcatgttccttttgcagagatggaaacattgcctcaaattagctctgtcatttcctaaggattccagggttctttagtagggggtctggatcctacgtcctgggccatccccatcatagtgcaccacgtcacctccctggccagggaccgtggggtctccacttttttggggtgctccatctatgcagggtttcctggaagcacagatgctggcacttcagggatgaatgaaagtctttttgggggatttgtagatttttttcttgtcttactagctccattttcaaatgtatttattttgtctctttagtttgcgcgataacaatatctcagaccgaggcatctgcaagctcattgaatgtgctcttcactgcgagcaattgcagaagttagcgtaagtcagcctgggctgtggacaatgggctccaagtgccctggtctcaccccaggtcgtgcagcctgggaagctgtgagtgatgggctggggcaggggctgtttgcatgatggggggtgcaggtgattcctgcccagaggggaagggcaaccctgggatttggtgctcactgtccaatgtgctttgcttctgtgtctcctctcttctggaactgaacagtctattcaacaacaaattgactgacggctgtgcacactccatggctaagctccttgcatgcaggcagaacttcttggcattgaggtgagcccaggttttccttattccctggaaactattttttgccccattcctgagtcagtctgatctggtcttggcctggcactgcccacactggctcctgacctcctgattgaatgcagggacagtgtctcattttaagcaggggttctctaatgctgtgatctccccagtaaactctggactagctctgctgaggacttcctgtcttttgacctttagcccgtagggcaagaaagcttttctaggcccctttccttttctgtgtctaagagtgtcacagctttctgggtttactgagttccacgatgcatgttgagctcgtcctggtgggggaggcatacacagttacttgccaccccagctgtggcagcgagttgctgcaacactcccaggaggtcctttcaccactcagagcatgcaaggtttgcagtccatctggttctgcatttctgctactccagtgtctcccagtttcaacaggagtctctctctctcctacctgatgcctttaaattgcccctctagctggccgctgggttggcctggcttctctctccttctctctctctcagatattcttgcctcctgtgatttgtgaggcagtaaaaaaagacaaagtaaagaattgcttccatctattcttttacctcttgggctgggtttgtggatgggagccgccattttaaaatggcgggccacatagctcagtctcggcaagggctactgagatcagaaccacaggtgccaatttgtacaaaggactcagtcctgctaccactgcctgatccctcagactcacaagcctggaataggctgtggccagacctggctggcccatccctgagaagggtgctagtttcagaaatggaggctgagtttgtggccaacacagtagtcctccggtatgtgcaggagagatgttctaagaccccagtggatgcctgaaaccatggagagtatcaagccctacacataccatgcttttcccaatacctacacacctgcaataaagtgtagtttataaattaggcacagtaagagagtaatagcaactcataataaaatagaacaattataacaatcaatgtactataataacactatgtgaatgtggactctctccatctccctcaaaatatcttcttgtactgtactcacccttcttcttgggaagatgtgtggtggtaaaatgcctgtgtgatgggaggaagtgaggtggatgacgcatgcagcactgtgctctagcgctgggctgctgttgacctgaccacacttcaggaggagaatcatctgctcccagagatccctaatctttgagcaacaatgaggtcggcagctggatgtcaggagcagacgatcttgatgattaccaaatgggagcgtatagagcgtggatgcgctggacggggggctgattcacgtcctgggtgggatggagctggatggcacgtgatcagaatagcatgcaatttaaaatgtatgaattgtttatctctagaattttccatttaatatttttggactgcagttgatttcagataactgaaaccatagaaggcgaagctgcggataagcagggggcagggattaccgtatatcattgtaatagagagcacaggctctggagccagactgcccgaggtttgaaccctcattagctgcgtgacctcaggtcagcccaatgtctgtgtgcctccgtttccccttctgtagaatggaggtaataaccctggctacctcacaggctgtagtgatgagcaagcaagttaatccacatgaagggctgcaccgtctggcaggggctttatatagtaagcgagtggctgaaagatgatgggtaaatcacacaagcactcagcttgtttctccttatgtgagtccggtcctccaagcagggattcaatgtgccacccatttattggggaaaagtcctaaaaggggaagtggggaagggagctgggggaggctgggaggtgtgtccctgagtgaaggagagagggaaggaaggaaggttgagactgggcaccttggacttcagtgcagtcctaagacatcttggcaaggctgatgaggagttcttgaaccaaattcaccaggcaggggagcctgatgtctcaggcaggggctggcaagtgcagatgcgaggatgttagattttggagcacagcagctggggcccttggctacctccaaggagctgaggctggagacctgaaaggcgagttctcctagctgccacaccccttctccaaggatacaataatatctgccttataggattgttgtgagctgagtggcttgacgttccttgaaagaatgaaagcgtatagttatcccaggaagcctagggttgcaggtgagagctctggggcttctccgaagctctccgaggtgtctggattcagttgcagcaggagccttccttgctgggatcttcccccacccctagccttggccctccctctctccttcctttctggaaggctcagtgggccccacccctccctccagccacctggacctgcccagcgctcttgtgcaacaggtaaagcctacctgtagcaacaacagatctgggaaggctgcagagggcacgatggggtctggatcgagggcggctgagaccagagggaaaggtgtgaccctgagtcaccctcgctgtcccggggaaaccacctcccaggacagctgcctactgtggctcctgcctggaattgtcacactgctgtgcaaacagcgtcccgctgcccctttccctttgctgggggaaaatgaagttgtgggagccgctgagtaaactagacctagcagcgagggcacctgatgtggctgctgcctcccgggcaggtcttcaatgctttcttcctgtgtttccctggccagggcacagacggccctccttttctgcctgccgctgtgttctctcagcctcctctgtcttcccttccaggctggggaataactacatcactgccgcgggagcccaagtgctggccgaggggctccgaggcaacacctccttgcagttcctggggtaggttggattccaggaagagggacctgcatggaggggcttgggacttttgaggatttaggggcaggtgaaactcttcagccaggaggccccagaggcagcccagctccagtggggaggacaagccagggagagagtgggcggcccttgactgccaccttcatacttggtctatgcctgacaaacaggaagtttgggatgttggggctaggggaggacagtgcccacgagctggtgacaggaagccctctgatcctcagggggcgctagggctgtactttagctgcatattaaaaccacctggaagcttctaaacactattgccaggcctcccaccccagactgatgaaatgcaaatatctaggtgcaaggcccaggtatcaggagttttaaaaagcttcccaggggatgtacagccaggggtgaggacccctgacctaagaaagagaaggaaatggggaaggataggaaggcacccaggataagaggggctgtgctaggtccctcggagctcttgctccctgtaggaccatgctagggcctgccagggaggggagtaccccaacctgcagccccagggtgggcttcctctgtttgctaggcacccaggcttgcacctgtgctgtttccagcagcctctctcctatcctgtcatgccctagtgtgaactggagtccatttgacaagaactgggagttttagaacctgggactgtaggaagagagaataaccttagggcctaggtgttccagcccatttcacagggaggcaagttgcccccaagctcagttttttgttttgttttgttttgtttgagatgtagtctcactctgttgcccaggctagagtgcagtggcacgatcttggctcactgcaacctccgcctccttggttcaagcgattcacctgcctcagcttctcaagtagctgggattataggcacccaccaccacgcccagctaatttttgtatttttagtagagacagggtttcaccatgttggcccggctggtcttgaactcctgatctcagatgatccgcccgcctcggcctcccaaagtgctgggattacaggtgtgagccaccgcacccggcccccaagctcagtttgagccacaaatgggactatgttgctctagaaatcaacatcttttccacactgcattagtagcaacagagtctagaacaaaggaggccacagccccactgaactctcttctgcttgaggtcacatctgccacatcaggggtatttacctctttcaacacatatttattagggcacctgtctgggccaggcgttgtgctaaaacccccaaacgctgtcatatgatacaaagtgttctgtaacttgcttggtttttttttttgtttgtttgtttgttttgttttgtttttgttgttgtttttttttgcttcgccatatattataggaatttttttaggtcattatgacctctttatttacttaattatctatttatttattttactaatatttacagaaagggtctcactctgtcacccaggctggagtgcagtggttgcaatcatagctcattgtagccttgaactcctgagctcaagtgatcttcctacctcggcctcctgagtagctgggactacaggcacaagccaccatgcctggccgatatttttatgttttgtagagacggggtctcactatgttgcccaggctggtctcaaactcctgggctcaggtgatcctccctcctttgcctcccaaagtattgggattacacaagtgagccaccttgctcagcctgacctcatttttcaaagagctgcagagtgttacataatgtatttaactggtcactttttgatgactattaagttgttttcaggttttttgttattacagtgtcatatccctggggcacagagcagtgctggcacatagccagagctcaatcgatacatacctaatgaatgaaagtacagtggacatcctaattcagccattctttgctaacttgtgtacatacctgtccagggtaggtccctagaatacagtcaataagtcagaaggtgtgagttgggatctaccttttggaaagggatgttttcaaactacagtgagtcagaggaggatggcccagaagctgggggagttgaagctgatggcgtgaaggaattaggggtgttaggaagaagcaggagataaagagctagcttgcagaagaagtgttagacttgttatgggcaggtactggagggtagctaaggacttgtgggtggcagttaccaggaagcgtatctgaactaagtgtcagaaaaagtgtcacaactgtaaattactcttgtcagtgagttcctgtccttaagggttagggctgggtagccctctactattctctaagtctgtaatgtaaagccactgaaaactcttgggttaagtttggccatcccacccaaaagatggaggcaggtccactttgctgggaccaggagccccagtgaggccactctgggattgagtggtcctgcccctctggctgggactgcagagggaggaggactgttagttcatgtctagaacacatatcaggtactcactgacactgtctgttgactcttttggccttttcagattctggggcaacagagtgggtgacgagggggcccaggccctggctgaagccttgggtgatcaccagagcttgaggtggctcaggtaagcttcagagtctatcctgcagttttcttggggagatcaggtgaagagggaggagctggggccagttctgaaggtctttgaactttatttctaccccacaatgttaggcaatggagtaaggaaaaaagaccattggatttcaagagaggacactcgagtctttctgggtgacttggaaatgtcccttgtcctctcagggttttgatacagtatctgtaaattgaagatattgggctggatcaggtacattttatcttaaggaccaattccaatccattggtagtgggtgcccagtgcaccacattaaaaagaattctaaggctgcacctgggcttaaagaagagcactataatcaattagtgatgtctaaaaaagctaaaaaaaaaaaaaaaagagcactgcattcaattagtgatgtctaaaaagggtagaaaaaaaaaaaaaaagaaaaaagaaagagcaccgcaatcaattagtgatgtctgaaatggagcagaccaggagagcaccacgaattttgccctccataggttagctcatctctgaggtctttccctgctctgacatacttttgttccatgattacctccagcctggtggggaacaacattggcagtgtgggtgcccaagccttggcactgatgctggcaaagaacgtcatgctagaagaactctggtgagtttgggggattctctgctctggggaagtggatcacaatctctgttgatcccctggcctcatccataggagcggttgtgtggacagacaaaggtggatgattgagtgattgactgattgattgattgtgtttgtctttatatgtactgagtggtatgaagcttatagagcctggtatgtacatgctaatttttttatttaataaaatatatgggtttgctggtttggtgactgcctccacatggcataagtgttaagagcacagactctgtaatcaagcaggccgtgatcttaggcaagttaaataacaatttcagaatctcaagtttcatgtctgtaaaatgagggtaagaatacttccaaccataaaggatttttgcaagaattagataaagtagtgcctgtgaagaccttaatatagtgcctggcatatttgtaagtgctccataaatgttaaattagaataatggcagggttactactactattactgctgctgctgctgctgctgctgctacaactactatagtactgtgactactactactaataaagttttgttattttaaagtgattttgagttcctaggagcactgggtattcaagtcttaggtcattttggaaggtgtaatggagttttgatagttgaaagaggaaccatgaatcatgcttatactgttgacctgaagcagattctaagtttctcatcctttagatgccactagtatagttttctgacatgttctgggcagcttcagattatgtcagggagataaaatactgaatgtttgattttcccgggaagcagaaaggcactgcaacatatgggcattgccataaacagattttatggatggaccttggctgttgcagggcttactagctctactcaagtatgattgattctatcctgactggattttgccacttggaatttcttagtagaggagaaccttgttatgagagcatcagttatgattactgttaaaagaaaaactttaggcaaattaaatttagcagaactggtttgaacatacagcaatttatgaattgggcagcattcagaactgggagtgctccacccagcaaggtaggcaagcagtatctatagacaggaaaaggaagtgatgtacaaaacagcttgattggttgcagctgggcatttgccttatatgggcatggtgtgatgaggcattttctttatatggatatagactgatcagctggtagactgtgactgactgaagcctggctgctgtgattggctaagacttagctgtttgttataaggatatgttgttaggttgcagtttgctacataggaactcaaagtacagaggcagtctcaggccaaatttagtttaactatatgttaagctgcaggtgacagaatacctccatctatagaggtttaaacaaggaaagggtttattttttcctgtataggcagctggatgtaggcagtgtagggtttgtacagtggctacaagaggccaggaggggtctcagctctgtctcattctcttcctgttccatcattcttagcctgtgacttcattcacatggttggttgtctcatgatcacaggatggctgctccaggtgcagcactacttctgtattcccggattcgatctatatacccaggaaagccatctgggttctctcctttaaaaagcattcctggaagccccacctgtcgacttccccttatgtatcaaccatgtgtatgtcacttgaccaacccacttgtatgttgtttgaccagccctggctgcaatggagagtgggaaatacagttttttcaccaagtgcatggctgtccaaatgaaatgagacttccattaataaggaagaaaggaaagatggagatcaggaagctgggggatcagggaacttattacattgagagcccttggagtgaattctcttgcaaatatgtccctggaattgagaatccccacaacgtactttatctgttctttctttatccatgagtttgggttttcagatgttggatttcctatatggggggcatgtgagttcatcatcttccataatcaatgttgtatcaactggattttctctcttcttctcaccagcctggaggagaaccatctccaggatgaaggtgtatgttctctcgcagaaggactgaagaaaaattcaagtttgaaaatcctgaagtaaggaacccataagcaggaaacaggacaataattgctggcctttggaaggggcatttctgaataagatctgggccgctctccgctgggctaactcatgtgaggtggcctggtagaacagcttgccttggtctaggtggacaaggattccagtgcaagttgtttatctgggaggtggtcccagtaaatgctgataggagagtggtgaagtgagatggggaagtgaaggtaaccaataaaggggagttatcaagccagttatcaatgagggaaattggagctcagtactctggggcactcctggagccagtgcagaacacacatggtcacctacccaaccaatgggcaagaaagccatggcatttatccaccaaccctctgtccttcctatgttgatgtgcgctcatggggcactgattctccagcacttccagctcaccctcacccagctgaacatgcttctggggtcaggagaatggcctcaggcagagagtggaaggtcttctctgcaagcagtggctggggaggtgatgtgatggggagtactgtggcctcctccagtggctgactcagtggcttgggacttgtgccacaaagagatggacagctcaggtgaacatgaacccacctagtgaccatcatgggtttgtcagggtgctctctgaggctgatgccaaaattcttatttcaagtagacctcaggaaccccatcagatggctccttttgctggaggaaagtggcatctgcctaggcaaatgtggtcctaggaaaacgcttgcctttagagacagacagacagacagctgcctctgtgagtgccagctttgctgccaggctgctacccactctggcgacactcatttgtgttgctttcacaagctaggaagtttccaaatatttggagaaaacacttccactaattatttgggtggaaatgggctgggaagttggggtgaagcccggatgtgtctgagccagatgccagctttgcactgagggtcggcctttgggaataccaagcccattatcaaccaggtgtggatatggcaggtttgtcttccctccttgtcacagccttactccacttgactcccatggatgccaggcaatgaggctggggttggtcccatgccaccctgtcatcagccttatttttcagcatcctaaactatatcatcccccacaaaaattgaacttctgatatatcttttataaaaaagagaaatgcctacatctttcttttccaggcttagtttctgccaagagttggttgagagcccaggcttgctgggtgcagtggctcacacctgtaatcccagcactttgggaggctgaggcgggtggatcacctgaagtggggagttccataccagcctgaccaacatggagaaaccccatctctactaaaaatacaaaattagccgggcgtggtggcatacacctgtaatcccatctactcaggaagctgaggcaggagaatcacttgaacctgggaggtggaggttgccatgagccaagatcacaccattgcaccctagactggacaagagagaaacttccatctcaaaaaaaaaaaaaaaaaggatgagaaaaataataatttaaaaaaaagagtccaggctctggaaccagacagcctgggtcttacccctgctccaccattaccagccagttcttcttggatgagtgcctcagttgcctcaagtgtaaatggagataatggctggaccttcattataggccatgagcattcactgagagaatgtagctaacaaaagtgagttgtaggttggagcaaaagtaattgtggtttcagaccatgaactttaaattattataactaggctaaaatacatctttattaatcaaaataggaaccattaaaatcaacacatttttgccaataagaaataagtttgtttattcctgtagcataaaaattcatgcttcgggattcaacaaactcttggaaagcattttctgcatcctcctggttgtggaagcatttttcctgcagaaagttgtcaagattcttgaagaaatggtagtcagttggctagaggtcaggtaaatatggcggatgaggcaaaacttcatagtccaattcattcaacttttgaagctttggttgtgtgacatgcagtcgggtgttgtcgtggagaattggaccctttctgttgacgaatgccggctgcaggtgttgcagttttcagtgcatctcattgacttgccgagcatacttctcatatgtaatggtttcgcagggattcagaaagctgtaggggatcagactagcagcagaccaccagtgaccatgaccttttttttttggtgcgaatttgcctttgggaagtgctttggagcttcttctcggtccaaccactgagctagtcattgccagttgtataaaatccacttttcatcgcacgtcacaatcagatcaagaaatggttcgctgttgttgtgtagaataagagaagatgacacttcaaaatgacgattttcttggttttcactcagctcatgaggcacacacttatcgaggtttttcacctttccaatttgcttcaaatgctgaatgaccatggaatggtcgatgttgagttctcaagtagttgtaagaaaatcagctttgatgattgctctcaattggtcattgtcagcttctgatggcctgccagtacactcctcatcttcaaggctcttatctccttcgcaaaacttcttgaaccaccactgcactatacgttagttagcagttcctgggccaaatgcattgctgatgttgtgagttgtctccgctgctttacaacccattttgaattcaaataagaaaattgcttgaatttgctttttgtctaacatcattttcatagtctaaaataaatataaaataaacagaaagtattaagtcattagcaaaaaatcataaagtgagaattgtgcattaaaatgatgtatagcataaccacatttatttaagaatgtattccaatatcaaatggcaaatttcaacaatgcaaaaactgcaattacttttgcaccaatctaatagaagttcaataaatactggcaattacaattggcattgccttagggtcaacttgtaagacattcctgaaattgtgggaaagggggaggacctggagtggacattattggaaggcaaagctgtaaccaaaagagcaacctgggaaacacatgactcctctgttgctgtccctggccctatcctgtctcccctccctgttgtcagctacctcatatgttctctaatctctgtctctgtgccctcaaagacccccctgaaaatagaaatattactgctcattggttattttctatcaattaagtactgtattagtccgttttcatgctgatgataaagatatacccaagactgggcactttatgaaagaaagagttttattgaacttacagttccacgtggctggggaggtctcacaatcatggctgaaggtgaaaggcacatctcacatggcagcagacaggagaagagggcttgttcagggaaactcccctttttaaaaccatcagatatcatgaaacttatttactgtaatgagaacaggatgggattcaattaccttccactgggtcgctcccacaacacgtgggaattcaagagatttgggtggggacacagccaaaccatatcaagtactgtgcaagtgttttaggcatgcagagagtggtgggtcttcccagcaagcagagtgtggggaggtaatgggggactggtggctgacttaatggcccaggacccatgccacaaggagatggatggtggatgtgaataggagcctgcttacacccatcacaatttagattcttatgctcgatggcacgggtactcttttaggcccattttaccaatgaggagattgggactaatttgctcgagatcaaaaaagaagtggtgtaggtgggatttaaacccaggatgtctagcactaaaatgcaggtacttaaccactatcctaagggagtggctacttaatttgataaactcatctagtgaatggaagagagacggttacatttcactgatggtactgagcctttgttgatgagctcattgggaatctcagacatgagcaggatgtgtctaagggacaggtgggcttcagtagactggctaactcctgcagtctctttaactggacagtttcaagaggaaaaccaagaatccttgaagctcaccattgtatcttcttttccaggttgtccaataactgcatcacctacctaggggcagaagccctcctgcaggcccttgaaaggaatgacaccatcctggaagtctggtaaggcccctgggcaggcctgttttagctctccgaacctcagtttttctatctgtaaaatggggtgacgggagagaggaatggcagaattttgaggatcccttctgattctgacattcagtgagaatgattctgcatgtgaaggatctgattctctgtctaagaaagaagtctttacctctttaagtagggagcaatgatttcatttttaaaccttgactatttattcagcaacttctctgctctatgagatagtgtaggaatggggatgtggttgaagaatgaaaagaaaagtcagctcccgccctcctagaaattgcatctgccttcacaggtcaaggatattggatcagaccttctgcggttctgaatggagattacacaggttaggagcaggttgcacagtgtttccaattctctataattaaagccatagactttcatgtattgaaaaaagcaagaattgcattcttgacagattctttcattgccttaaaaagaatgactagccttgggagtctgggcagctgggtccagtgttgtagactttctctctgctgagccacagcttcaaagatttgtccttcttgtttccagggatctatttctcagacaataagtaaaggctttccctggcctaatgtgctgtaagtgaatgctactatatatgttccaggcactgggctagagactaatatttaaaagccaggaaatttcctatagaaaatctatatctcagggttttctcaaaagagctgggaactctggatgcccattcatgattccagtagttaaccagagtacaagaagggctgagtcttctcagatgggcaaacccactctggctgactgcagatccaccaagcctattgtcttagaccaggaccctttggcaactcattcccataagcctgtgacccttgctttaaatatgcaggccttgtcttctctcaaaaagcacatcaaggctgcagcgaatgcagatatcaaatgatgaagttaaaaacaaaagctttgctgggcgtggcagctcacacctgtaatcctagcactttgggaggctgaggcaggaggatcactttaggccagaggttcaacaccagaccttgtctctcaaaaaataaaaaattcagctgggtgcggtgtagttcctagccacttgggaggctgggatggaaggatcccttgaacccaggagttcaaggctgcagtgggccatgattgcatcactgcacaggcgacagaattagatcccatctcttaaaaaaataaaaaatttaaaagtgacttcaaaaatctatgctgtgatggagagatttttccttctgtatgattgtgatagctctgtggcctatgacgtcatcaggttctgggcaaagtgtaggttttctgtttctttgtttttgaaaccattgcacagtcctaagaaacatcacattctgggtcctgggcaccagccaacatgaggttgatattttaaggggtctgatgttatttgctgcctgttgatggaacttgggagggcaccagggtttgctcattgcattcttgacagattctcttattgccttaaaaagaatcactggccttggggagtctgtggctggctgggtgcagtgttgtggactctctctgcagagtcatggagccttgttcagaatgcttcctgagctgccctggttggccaagggtaaaaacagccctgacttccctgcaagaaacactgcagctgggccagagagtcagcccatcccaggcatgggtttaaaaagtggaggcttttgtttgaaagccctgctctaattttgtcctcactcaaacctctgttcacttgatctgctttaggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaac

SEQ ID NO: 1899 - DNA, 15492 bp, Homo sapiens
gccgcccgggggcttttgccagcggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccaccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtgagctccggccgccctgccctgccccctctactgtcccggctgctcccgcccgcagccccgacggggctctctgggcgggccgggcgggccagagtgaggggaagagctgggagaaaccgtggtgagcgctgcgcggggggcagaggtgctggacgtgagcactggtgggcgccgagtactccgatctggggtggtgacaagccatatcagagtccgggctcggggtgcttgggtgcctccacatggccatgcctgccccagcaagagtggtagatgcatcccgaagttagctctgtaagaagcccgccccatgtgcgttcaggagcgaaaggagggactcagaagctctaacccagctgggggcgtcaggaggtggggacaaggagaaagaccttgcgctgtcttgtgccccggcacccgaggccggaagttgttagccgtgttcttttatcagctcctagaggggatttcctgacaccccttttccaccgcattttccgagagcctcagcctgggggtttgacaaccagtccccctcagttttttctccagaaacttgccactgagtcactgcgtgtgagggaggagggagggacatgttcccgttgaatgggctctttattttttatttgttccaagacggagtctcgctctgtcgcccaggctggagtgcagtggtgcaatctcggctcactgaaatttccacctcctgagttcaagcgattctcatgcctcagcctcccgagtagctgggattacaggctcgcgccaccacgcccggctaatttttgtgttcttagtagagacggggtttcaccctgttggccaggctgatctttaactctcgacctcgtgatctgccaaatctcggcctcccaaagtgctgggattacaggcgtgagctaccacacccggcccaatgggctctttcttgatctagggcataggcatgctttcctttccccaccatcccaaagagctggagtgcaaagcctctgaggtgtggggtgggtgaggctgcggatgggcctgagaagtggctctggggataccctcaggcttggcatattgaagtttctccgttgcaggggactacataataactacattattaccactcggtgatatcagcctgccatgaatggactctgctccccgcccctcagttctgtagaccagagcactcctgcccccgccaccagtgagctaagcccttggccttgagggagggagtggctgcacccttcgtgttttcttgggaagggagtgtgtctgaaactctccctgctttgccttgcagcagagcctgaattttttaaggcccagagcacgctgggccacagtggaaaggccgggagatggggagtgggaagcagccttccctgctcagttacttgctgcctgtgtgacctcaagcaactcactctccctgtccgggcctcaattcctgaattgatcaaagaaggctgctactcaaaagtttctctgactttgagaataaaattgagggagcccctgaaaggagatcagggagtgtgtttgcataaacagacggcactctcatttttagtttagacaggacggacttctgctctgttaatttcaaatcctaagagaccaggttctgcctgctgcctgaagaatctctaaaagcagctggcatttactgaacactcactcagtgctaggtgccttaactcctgggcttactcaacaaccctctgtggtgattttgtcaaagggctctcccaagaccgcacagccagtctggtggagcgggatttgaacccagctctgctggtgttcagaacttgctcaggcacttgtacccattgcggtgtataggaactctgattgatgtccagccagggatgtgttaggacactaggaaatgagaaatagggcaaaagagtttctttttttttttttttttttttgagacggagtcttgctctgtcacccaggctggagtgcagtggtgcgatcttggctcactgcaagctctgactcctgggttcacgccattctgctgcctcagcctctggagtagctgggactacaggcgcccacaaccacgcctggctaattttttttgtatttttttagtagagacggggtttcaccgtgttagcgaggatcgtctcgatctcctgacctcatgatccacccgcctcggcctcccaaagtgctgggattagaggcgtgagccaccggcgcccggccgcaaaagagtttcttttaagccaaagaaagttttataattggtggtggggagggagctaccagttgtcagcttttccctgcagcgcttggtatttaagataatggttcccccttttcttgtggtcatgagtttatagctgccccaggctccttctcactcctgaggggtgagatccagatgaatgacactttcctgccttctcaagtcccttcttcctttcgaagacaggcctcatggtcaaatgtcacctccttctcttgctaaaaacagtgtggggaagtcaggagactggggcagccagtggcatggagtgggccttggcccacccagtctgtctcttggggacttttattttcccccacctgggtggagaaggcttcctggcactactgatggaatccccaaagttctgcaggcagggaaggaccgaaccccatgatactctccattctgcagttacaagaaggtaactgcatgtgccatgaagttggaaatctataggagggatgggattgggtgcagggtctgaccatgccccactcccacttagacacccagcctgtaagtgagcttgggagaggagagggtgccagcagccccaacgccatggtaacagagtgacaagtttcctggattactctcccttggcttatgagtcagcacaaccaacttcctgcccccagagggcttccttcccagagacctggaaagtcagaggagctgacttgacctttgattgccaagggatggggtcaaccaggtgagattgagggagggtctcccacaaatcctggaggggattgagaggttccccacttcatgggtagaacagcctggccaggtggccgggaagtgttggggatggctggtgggtgacctcaggcaagaggctttacttctttgaagccagttttcttttcttttcttttctttttttttgagacggagtttcctctttgttgcccaggctggagtgcagtagcacaatctcagctcactgcaacctccacctcccaggttcaagcgattctcctgcctcagcctcccgaatagctgggattacaggcacacaccacctcacctggctaatttttgtatttttagtagagacggggtttcaccatgttggccagggtggtctcaaactcctgatctcaggtgatccacccgcctcggcctcccaaagtgctgggattacaggtgtgagccaccatgcctggctgaagccagttttttaatgtgtatggagatggcaggtatcctgctctcccatggactcatatgaaggttcattatgaggccagactgggcccatgaaacacaggaattttcagggtctgatgatgcacaccttgcccggaccctctctgatctgcagatgagattcttgctccacacggcagttctaggaacagcaggcctcaggcgcaccatcctccaaactctaatgagagatacaaagcaagggggcctggatatagcataggatcagcatcccgtagagctccttaagcccagagtactcttgtgggctttgattcaggtcctctgtgcctcagtttatacttcattgagaggcagccagcctcagcctgaccccgtcccctgcaggactggcgagcatatgtggtgatcttgtctgctggggaaggcaggctgtaacattagcctgagctgaagataattgggaaggtcagtctgctgccgtaaacaaaatgctttccatgacctgggatcaattatttttggattatctgcctcctcagttctctgcccgccagcacccttttgttcccaagttctagagctggttcagaagtttcctgtaatttctatgaaaatgagttggaaggaacgactcaagtcataagacactgagcctctgtgacgtgttcagagttcagggaccatgtaaatgagcaagaaattgctattactattcctagtactgatcactgatagtaattattattgctgttgttgattgggctcttgcaataggctagatggtgccccacgtagcatcttgtgtgatcctcctataaaccaggtgagtataggtgatggtcattgagaggaaagacttgcgcatggtcacctggctgggaagctgcagagccctgtggctgtggtgtagcgccattgctgtgggagagaaagcatcagagagtgtaggggaacagagctgagaagctcaagcagggtaaggtcagaacagacacttgagcaagacaacttggttcaaatcccagctctacctcttataagggcaagaccttaggcaagtcatttaacctttctgggcctcagtttcttcatctttaaaatggagtacggccgggcgcattggctcacgcttgtaatcccagcactttgggaggccgaagtgggcgaatcacctgaggtcaggagttcaagaccagcctggccaacatggtgaaaccccatctctactaaaaatacaaaaattagccgggtgtagttgtgcatacctgtaattccagctactcgggaggctgaggcagaagaattgcttgaacctgggaggcggaggttgcaatgagcagaggttgcaccactgcactccagcctgggcaacagagtgagactccatctcaaaaaaaaaaaaaaaaaaaatttttgcagagcacttacagtatctgacccgagtatcccagaaacttgcttacccttttttccattgtgttagggctgctaagggttaactgagaagaatctggttcttgccgagccttgagtgtggtggagttaggacttgagaaagccttcaagtcaaaggaaatggcaggaacagttaaagaagagaaattacagggcctaggggaaaggtacaggggctgtggttggggttgagggtcttcaggaagtagtagagaacggtgaatttagccaggcaagatgatggagggccttgattgggtgggaaatttgaactcttggataggcaacagggagccattgaaggttttagacaggagttacatgatgaattctatgatgacggtggtggtggttgtgattactgtttactgaaaccctgttgtgccaggcatgagcctgaacgcttttctttcattcttactgaatcctcaccatagctcttaaaagtatgtactgtaaacaggaaaactaaggctcctagaagttaagattctccagctagtagaattccagctctggtctttctggctgggagccagttgaagagaaagtctgggtctgtgtcccgctgaccctgtatgcaaattcagcctattcatggcttgtaacaaatttactaagttgcaaccaacacattttgttgtttctttcttttgataactttggtaccaagctcctggtcctttttagaatgagataagggtgaaatgaaacaaagtcgcagcacgcattgcatcttgcaagaccttactgatgtgctgtaaggctaaatgttgattggttaaacttttgtttctgttataaacgcgtgtgtgtctatttatagaaacatttggagtcctggactgtcatggtcaagactttgtaaaccactgcacactaggcctcaataccctcttaagagatggtttgcatttgaggtggggccggcaggctcagacagctccgggtgaccctgcatggttgcggcctagagggcctcatgttccaggctgcagccacccaccctcctaaaagggtggacaagaaaagaactaggccaggggaaggaaggctgtgggacctgaggtcaggcccagcatgggagggctgcctcagagggcctggacttgcaggcgccaggtgcccagggtctccatggagcccagcaggagccaggagagatagctggcaatcaggcgaggtgggctgacggctggtatggtccgtcagggccagccaggccttgcccttcgcagaattatgtaaccctcttcttggcccttgctaaggtttggcatctctagccaaaaccctattggggggatccatggaccagtgtgaggtggagctggtggtcttttgcctttcctatcccttatagggcttgcctcgccaggttcaggcggccagtggctggcggggggctgtttattttgggctgacgggctatatttaccttgtgaagctgcgtgcgatctgatctgatccaatcttgctggggctcagctggggctctggcagtcagctgccagatctgtagggcccctggccctccccctgccacccaaggggagatttccagagcaggaagtatcctggaaaaagtggtggcatttattcctgtgactttttcatcaagctccatgacacatgccaaccgttcctttcttctcacttttttttttcccagttgcaagattttattaaaattttttttgtttgtttcttagaactttatttatttatttatttatttatttatttatttattgatcattcttgggtgtttctcgcagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccgtttaaccctgagtggacacagcacatgtttcagagagcacagggttgggggtaaggtcacagatcaacaggatcccaaggcagaagaatttttcttagtacagaacaaaatgaaaagtctcccacgtctacctctttctacacagacacggcaatcatccgatttctcaatcttttccccacctttcccgcctttctattccacaaaaccgccattgtcatcatggcccgttctcaatgagctgttgggtacacctcccagacggggtggtggccgggcagaggggctcctcacttcccagtaggggcggccaggcagaggcgccccgcacctcccggacggggcggctggccgggcagaggctgcaatctcggcactttgggaggccaaggcaggcggctgggaggtggatgttgtagcgagccgagatcacgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccacccaaaagatacgaaaaccagtcaggcgtggcggcgcacgcctgcaatcgcaggcactcggcaggctgaggcaggagaatcaggcagggaggctgcagtgagctgagatggcagcagtacagtccagcttcggctcggcatcagagggagactgtggaaagagagggagagggagactgtggggagagggagggggagggagagggagagggagagggcctttcttctcactttgaatcattcttttacacggccccctgaaccctgtggcattgaacttggttccaagtgtgggcacatacagcctgcctaagtggacggagttccaggaatcgtagggtctggtgagggtaatgggctttcttccggagcagggcagcaggccctttcctcttcctcggagagcccagcctctcccctctccccagcccaaaacctcagggctggcgagtgtgggtgtccccgggccgtgtgcgtcccaacagctgcactgctttctggccctggagcctgtgggtgtgacaaatggtgtggaatgtggtggtctctgtcctgtggaggtggccatcaggccaggtgtggcgtggggtacacatccttgtggccgaggtttggagctggagctgcctctaaatatagcaagcgaggccccgagtcggggttggaaggtgggtatgtggggtccctgtctccagtctgagctgagggtatccaggcactatttctcttccatccacttcaagctctgtttttctccttttttcttttcttttcttttttttagagatagagtcctgctctgttgcccaggttgtagtgcagtgatgggatcatagctcactgcagccttgaactcctgggctcaagggatcctcctgccttagcctctcaagtagctgggactggccaggtgcggtggctcacacctgtaatcccagcactttgtgaggctgaggtggggagatcatctgaggtcgggagttcaagaccagcctgagcaacaaggtgaaaccccgtctctactaaaaatacaaaagttagctgggcatagtggcgggcgcctgtaatcccagctactcaggaggctgaggcaggagaatcgcttgaacccgggagggggaggttgcagtgagccaaattgtgccagcgcactccagcctgggtgacagagtgagactccatctcaaaaaacaaaaagtagctggggctacagtcatgcccactatatccagctaatttttttttctttgtgtgtgtgtgtgtgtctgtgtgtgtgtgtgagatagggtctcactttgttgcccaggctggggtgcagtagcgcaatcacggctcattgtagcctcaacctcctgggctcaagggattctctcacctcagccttctgagtagctaggactacaggtatactcactacacccagctaattttttgattttgtagagatgaggtctcactgtgttgcccagggagatctcgaattcctggactcaagtgatcctcctacatcagctccctaaattgctggattacaggtgtgtgcctgctttatgtgtttttctttctttctttctttctttttttttttttttttttttttagacagagtttcgctcttgttgccctggctggagtgcaatggcgcgatcttggttcactgcaacctccacctcctgggttcaagcgattctcctgcctcagcctcctgagcagctgggactataggcacgcattaccacgcccagctaatttttgtatttttagtagagacggggtttcaccatattggccaggctggtctcgagctcttgacctcgtgatccacccacctcggcctcccaaagtgctgggattgcatacgtgagccaccgcgcccggccctgtgtttttctttttaaccaagatttattgagctgctgtagctggccctatgctaaacatctacatatgaaaactacatttaatctcagccaccatgtgagggaggtgctcctttgcccccttcatacccgggctgtggagccaagtggacttggttttgaatccagcagcagagtaaccctttggacagctgacatcacctttctgagcctcagtttcctcgtttgtaaaagaagaataatggtattagtaactcgtgggattctcttttttttttttttttttgagacagaccatgctctgtcaccaagactggagtgtagtggcactatcttggctcactgcaacctctgcctcccgggttcaagcgattctcctgcctcagcctcccaattagctgggattacaggtgcccaccaccacaccccagctaattttttttttttttttgagatggagtctcactctgttgcccacaccggagtatagtggcatgatttcggttcactgcaacctccatgtccaggttcaagcgattctcatggctcagcctcccaattttctgggattacaggtgtgtgccaccacactcagctaatttttttgtattttaagtagaggcagggtgtcaccatgttggcccggctgatcttgaactcctaacctcaagttatctgcctgcttcggcctcccaaagtgctgggattacaggcatgagccaccacacctggcccacccctgactaatttttgtatttttagtagagacagggtttcaccatgttggccaggctggtcttgaactcctggcctcaagtgatccaccctcctcagcttcccagtgtgctgggattacaggcatgagccactgcccctgtcagcctctattttataggtgtggaagctgtggcacagagaggttgagatccttatccaaggtcaacagctttgtaagtggaggagccagtttgcagccagctgtgtggtttgttctgtggtcctgactgcatagagggggagagacactacctcgggggtggctggggcacaggcgaggcaccaagtagggagcagaatgggactgcagacctgtatacaggccccccatacacaccccagcggccagctcagggcctgagccacctaaaggctccagacgtttccagtgagtggatcagtagcagtggacctggggcagctcagcaacagccgctgctgcttgtcctgtcttgggtttcaggttccggggtggcaggccagagcaggaagaggaagtgctgggggtggggaggtggcaggagacactggctgctggagggggctcccctcttccaggtgtaggcaggcctgggggcagagacaagggagctgcaggatgtggccctccatctgccgtgccctggtgacctaccccacgtcttgtgtccagcacccacatgtgctgagataccctcacccgcatggactcagaattctcagggctggctttcggccaccaaagatcttaaacacggtagaaatcctgatggcattgccccaaatttatatgagcttgaaatgttttgtaaacgcctggactgagaagtacatactgccatccactgtgggcattcttagacaaaagcctgtgaatcctgttgaaattgtcagaaaagtcctgtgaataaatgatacttggctgttttaaggagagtgtccaccatcttcagattctcagagatgtccgaccccaagtcagatccagattgtgaccttcatctcgctgcagcccctttttttatgggtgttgaggagggtcttggccaaggttaccggtaaacaggcagttaaggagctggaacatgggtttgccagtttggcctggcgttctttatgcctgagtgtgcccctctggaggatgttgtaaagagactgtggggtggggatgaggttcctaaactgagtaataatgaagctcacttttattgagggtttgttgtgtgccggacactacctgttttacatggattgactctcttaatcctcagaagaagccttcgaggcttgtcccattattcccattttacagatgtgaaaacagaggcacagaaagttgaaagcttgccagagtcatacagcccaatcaagggcaggggagtcagggttcaagccaggcagactgtaaaaggagagcggtggggaaggaaggagtccacacccctacctagggcaggaggggtgaggacaggaattccctgcctgctgggggccaggctagtgtgcggctaatggagaaacttcaacattaggcttgccgctctgagcctgccacatatatagcaaacaccttataaagagtcactgtccttgatggaatgactgccataggtatccgccatctccctacccctgtccctccagccctcatgggttgaccatggttgtgtgcccactgcccgctgctcctggcccagatctgataagctggctcctttgcatgggggtgacttgcaaggcccaggtgaggagcagcgggtgtctggcccggagcatgcccctggtgacctcgggtccacaggtctccaggaactgggggcagctggtgtgtcagccctggggctggggaggagacagccccagggtgtactggccacccagcctgcaccagggctgggcccgtcgcttctgggaagcctgctctgtatgtcaggtcgtgcgctgtgttctcagaagggcctgagtgtgccctgggagggcagccaccacccctctgcatgtccccagagcagggcatgaaggagaagcctctgcttgggtgtgaggatgtggggccagcaggcatgatggctggcgattgctttttttaatgcttttattttaaccatagtaaaatacgcataacaaaatttaccattttgaccactgatggtggtggttggtactaattttaattttattattattattattattattattattattattattattattattgagttagagtctcactctattgcccaggctggagtgcagtggcacgatctcagctcactgcaacctccgccacccgggttcaagtgattctcctgcctcagcctcccaagtagctgggattacaggcacgtgccaccacgcccagctaatttttgtattttcagtagagatggggtttcaccatgttggccaggctggtctccaactcctgacctcaggtgatccacccgcctcaatttcccaaagtgctgggattacaggcatgagccactgggcccggcctgattttattttttttagagacaaggtcttgctctggtgcccagactggagggccatggggcagtcatagctcaccaccacctcaaactcctgggctccagcgatccttccccaccagactcccaagtagctagaactacaggtgtgcaccaccaccccccagctaattaaacaaattttttttatagaggtggggtttctctgtgttgcctggctgctctcgaactcctggcctcaagcagtcctcccaccgcagcctccacaagtattgagattacaggcgtgagccactgtgcctgtcctgcggctggtttctaatacctggctaggtggtaatagcagtgttttgggaggtggttaccatgtgccagctctcatttaattgttaaaataattctatgaattggctgggtgtggtggctcacacatgtaatcccaacactttgggaggctgaggcaggcaggtgggtcacctgaggttgggagttcgagaccagcctggccgacatggtgaaaccccgtctctaccaaaagtacaaaaaagtagcaaggtgtggtggcgcatgcctgtaatcccaggtactcgggaggctgaggcaggaggatcacttgaacccgggagtggaggttgcagtcagccgagatcgcatcactgggctccagcctgggcaaaagagcacgactctgtttggagaaaaaaaaaaaaaaaatcctatgaactactattatatccctattttacggataagaaagtcgaggctcaggccgggcgcggtggctcacacctgtaatcccagcactttgggaggctgaggcgggcggatcacgaggtcagaagatcgagaccatcctggctaacacggtgaaaccccgtctgctaaaaatacaaaaaattagccgggcgtggtggcaggcgcctgtagtcccggctacttgggaggctgaggcaggagaatggcgtgaacccgggaggtggagcttgcagtgagccgagatcgcgacactgcactccagcctagcttgggcaacagagtgagactccctctcaaaaaaaaagaaaagaaaagaaaatcgaggctcagagaggttaagtgactttcccagggttgcacagttagtgagtgccagggctgggattcagatccaggcagccttggctcttgctttctgtagggctttctgccactctcatccacaagtggataggccttactatccccattgtagacatatgaaaactgaggctcggagaggccaagcgactggccagggtcccagagcctgacaggaggagagctaggactgaagagtagtagtgtgggctgggaccgctggcactcatcctgcctgtccccccgcaggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctcc

SEQ ID NO: 1900 - DNA, 33329 bp, Homo sapiens
ttatcttttaaaagccctctttaattccaaggagataaagaaagttatttgtcattaaacatgttacatgtatgactaatatttattatagctaatataatagtttagaacaaggaaatttagtagagttgtaacattttggtgctacatgtataattcagcataagccaaagcctttttaaaataaccaatactatcattttatgaaatctttacaagataagcacagtagtacaatatttaagcatctcaagtctccatttaagagttgactatcaaagaatgactgttataaataaagagctctatgatgttccacttatttagtcttaataaggtagggaaataagtgacatactttttagaagaatccatgcagtggacagaaagtcagattaggtagtccctagggatccatccagctctgggaatctatcatcagatggcctctaaggtttcttctagctcagaaaatagaggtacttggaacataattttttaaattttaaatggttatataggttaatagtattttttgcttttcaaaattcattgctggtgatgtctattacttatttgatgtcatgtctttggccaggaatgcaatcctaattagcattgttccaggaaaacatttcattttatagggagcatatcccagaaacattagaaaatactagtcccaatataagtaacatttaccaactagactctgggctacactttaaaatatctgatgttcagccaggtgtggtgcttatgcttgtaatcccagcactttgggaggctaaggcaggaggatctcttgaactcaggagttcaagaccagcttgggcaacatagtgagacactgtctctacaaaaaaaaaaaaaaaaaaaattaattataaaaaaaaaagaaaaaatatatctgatgttatttctatctctcaagttcaacaataaataatccaaagtacatttttatttgcagcaaaatttaagacagacagtactttcttttttctttttttttttttttttttgagacaaggtctggctctgtcgcccaggttggaatgcagtggtacaatcttggctcattgcaacctccacctcccgggctcaagacatcctcccatctcagcctcccaagtagctaggactacaggcacttaccaccatacccagctaatttttgtattttttgcagagacagtgtttcactatgttgtccaggctggtctcgaactcataagctccagcgatctgcttcagcctcccaaagtgctgcaaatacaggtatgagacactgtgtccagctgatggtactcataaaagtaggcatctaaactcaatacctgaaaaacaaatgtgatgttaaattacatctgaaattttaaaaatgtatttaaaaatccaaataaagcttacaatttccttatttcctttattttaatgtgtcaaaaaaacacttaaagatattcttgtaaatacatataagctgtgtgtcaacattcagtactatgcaaatcatttttcaatatgacaaaatgaaaaacttacacactttagggtagcgcttaatacttatctttgaaatctattgctgatgctaggtctaaagagcaatgactcaaccagaaaaaatagtaaaggctgccttttcctttttaaagtgcttattagctttatatccaaaaacaatggtttttacaaatacataatactgaaaggtgctcaaaaagtcaccacttacagaattgaacatgtcattttctaactctgcacatgtaaacttgttttatctgcattaatgaagattgcttcaaatggctctcaatcatatgcttcaaatcaagacagtgctaagttccagcagcataaacagtgacagcagaacaaaccccagcacattttcagtggatcacagcagatcagagaaagtgtaacagcttttgagtatgttatacatccaagagccttatatttcactccacataaacagtaaacataaaagaaaaaagaaacactttgtctccctatagagcattttatagtataggaagggattcaaattctctttttaacaaaattcttgtttctatatagaggagattttatattcttaatgtttacaacaaagcctatttccaccaaaaaagcaagaagaaattaataaatgaaatcctgaactctaaaaacctaagaaataaaactgtgaacaattctgaaacggagtgttttttctaaaggctaatacaaacataccaaaatagaatttctgagcacgaactatgtgatttcatttcaatcgtatcactttcatctgattgaaataatttagaaacaataaggatgatcttaatctcactattttctgcatgagactatcgttccgattcatcccctcaatacacaccactgtccaacagtcttacagtgagcatcctctcaggtccctttctgctcgctgaaccttaagctggttttacccctcctgtctctcttctccaaaatcctctatatatcttaagaagaaaatattcctttaaaaaatgacaatttaaatacagtgtgataatgctacatttgatttaaagtagtaataaattataaattgccaaataacttaatgtaattcacgatgcaaatccttggtataaaaataatccatattgccctgaatataataaagcaatccagtgatttttaaattacttatgaaataaaggcaaaaataagatgtaaaatactatttataaaagtcaagtaagaaaccagttaccataaatctttttacaaagataaatgtaatgtggcttactacttttaaaaattgtcagggaggtttgcaatcagtggtttcaaaaatgactctagggaaactagagactgaattatatattattgtgatgtacaacatattaactatatatataacaataatactgcaatggggggtaattaagctacttcctaacaagtacatttctttttcaaagtctttactgtaactgattaatttttaaatgttagttttcaaaaacttttctacttgagatatttatgttagtaagaagataccagaagtctagaatagtaatcaaatgcctataaaataaaataatgattgttcttgcatgttctgttattgtgacaaatacacattaaaatagataacattgctatgcctggaaattaaaaatatccaaatctgttagaaagaagtggaaaaggaaagaaaaatcgaaaattcttatttaaaaatggatctgaagtccttgtatttcttaagagcttgacttgtcaaatcacagtttatcttctttctgaaaccaagttgtgtcttccaccattcattcacgtgatatgtcaattctccattttgtaggtctcagtttgaattttcctgaatatttgcaaaactggtactggacttgagacgtttggctagataaatcaaaagaattatattttaatttaaatttaattatcaaacatgattatttactatttttatgtaatctatagtatttatctattaattctatgtttgaatcctaacagttccagccttataagaattaaaacctaattaaaacttttttctaccaaccttaaaaacacataactttgttagaaattgcacatgactttgttagaagcagtacaaataaaacaacatcatttatatcttcttgaacatcacaatcttaaatatgtaatgtacgtgaaataaatgtacttagacaatgaaagtgctataaggtagaataacaaaattatacatctaaaagtctaagttagaaatccaaatctgaatttctcttaaaagaattcagtgaaaacttccccaacctgataaagagcatgtacaaagattctatagcaatcattatgcttaactgtgaaagactgaatgatttttccccctaagatctggaataagacgaaaatacctggtcttgcttgacatcatgccactaatttatcaccagcgcaacaaggcaagagaaagaaaaggaaagctatacatattggaaagaaagaaagaaaactgcttctattttcagatgaaaaaaaaatcagtgaaagaactctgtaatgggaaaaaaaaaaaacaaaaacattttaatgaccctcaaagaaaagtgagttgtatattattatggaactctgtattgtaaaaaaaaaattttaatgatcctcaaagaaaagtgagttttatgttatataaacacacaaacacatatggctgctaacaaaatacgttaccatcaattctgatttgatgctaatgggactgagtcattagggttaataaaacaaatcatggctatttggcttggtaatatgttttgtacttatagttaaacatgaatgtttctcatgttctagaaatgaaaaacaatcatgcccatagtgagagtattttatactgagtaactaagagtctccctacttcagagcttcacaaaacttgggtaggggttatgatttagaagctctgcaatgggaccctagtacctgtacttttttaaagctctgcagataattctgatgtgtagccaaggatgagaaccagtgtttctggtttctttttttattttattttatttattttttttgagacggactctcggctttgtcacccaggctggagtgcaatggctcgaacttggctcactgcaagctccgcctcctgggttcacaccattctcctgcctcagcctcccaagtagctgggactacaggtgcccaccaccacgcccagctaattttttttttttttttttttttttggtatttttagtagagacaggatttcaccgtgttagccaggacggtcttgatctcctgacctcatgatccgtctgccccggcctcccaaagtgctgggattacaggcgtgagccaccgtgcctggcctaccaatgtctctggtttcttttttttcttttttttttttgagacggagtctcactctgtcgcccaggctggagtgcagtggcgcgatctcagctcactgcaacctctgcctcctgggttcaagcgattttcctgcctcagcctcccgagtagctgggactacaggcgtctgccaccacgcccggctaattttttttttgtatttttagtagagatggggtttcaccgtgttagccaggatggtctcaatctcctgacctcatgatccacctgcctcggcctcccaaagtgctgggattacaggcgtgagccaccgcgcccggcctgtctctggtttctatcaactgtaagtggaaaatcacaacatgacttcctggacgagtgtactgcttcagcttaaaataaagggaaaacttaaactaaaaacattggcctaaactaaaatctacttcttaagccttcagtagatttgggaggcaaaccaaatcaatagtttgggtttttgagaattactttgttaaaaactactagaagtgatctagcttctgacaaaattcaaatgacttaataaactggacaagttaaatacgaatgagtacatacacctacatcttccttgcctttatattccctacctgataaatccccacatcctttaaaattctagcccagggatcatctaacggtgaatttcaacacctctaatgcagttagctcctcccttcaggcagggaagacaaacaaataaagtagagaataaatgaaaaagatgatttaaataaccaattatttaatttaaattagtttaagtgattaagtgccattaaagaaagacggcacagaagaacaaatggagaggtgtattcttagactggggagtcataaaaggtctctttgagcaagtaactttagagctaagacctggcttgcaagaagccaggtaagtaaagagggaagggccttggaaaaggggcagtgtgaatgagcttggtagtggagaagaacagaaaggaaccagactgtccacagcaccatgagcaatgaggagaatggatgtgacgagtttagaaaggtggctatgggccaggtcatgtacagcttggagagcagaccctggaaagtaagtttggatttattctaggtacaatgggaacacattaagcattccaagttagtagagaaacatggtgaatttgtgtttaaaaaattattctagccactatgtggcgtatggattttagtagatcaagaaatggaaggagggataccagttaaggggctcttgcgttagtacagataagagatgaagatggtttgggctagggtttaccagtggagggagagagacggactaagcagaactggcagcatacttgctaatgaattaaaaggggatgagaggggaatgtgggaatggaaaaataaaagaaagaaaataattaagaaatgactacaaggtttgtggcttccatagcaaatagtgacactggtagtgacttttactttgacagcaaacaaaaaatcctgatcagaagcagtaaatactttccataaagttaaatagattagcaaggcaaataagatgctaaactttaaaagtataccaagctctgaaaaatagtttctcaatggtgaggtgcccacaatattttgctattattctaagtaagtgctttaaggacctgagctactgcatatttacagaatgctggcagccttcaaaaaacctttaataaatacacccatgacaaagactctcccctctagtagctagcattttaaggtgacaaaacattacaaattcagttcaaactgatctacaggtaacctttttttaaaaaaattagatatattagaagtgaagttagatgaagtagtgatcgaaatttatagggaaaagaatttttatatcagacattcctagactacaaatagtatttgagagaaaagaaaattaaccttttcccctaaacagttctcttttttaaaaactaaaattattaaggcataagcctgtactttcattctgataataaacaagaaagccacgtgacttagaagccactcttccttagctggatgggatctctagttagtgcttcttttgctctggcctatttcatagggagaaagaaagggaattaatatgtattgagcatatactattatatcaagtaatctccttggaactacgattccaatttgttcacaaacaaactgtctgttatgtcagctatagtttcttcctgcctgccacacttaggtggttctaccatgactccgatgggtctaagagctgtctgtatctccctgctattgccatgttaggagtgcaaagcctctgttgttattcttctgttgttgccaaccttattccaggggtaatctagctttctcaatttaatcatctgaaagacactgtgttttaacttttttttttttttttttttttgagacagtctcactctgtctcccaggctggcgtgcagtggtgcgatctcggttcactgcaacctccgcctcccaagttcaaatgattctcctgcctcagcctcccgagtagctggaactacaggcatgcgccatcatgcccggctaattttttgcatttttagtagagatggggtttcaccgtgttagccaggatggtctcgatctcctgacctcgtgatccgcccacctcatcctcccaaagtgctgggattacaggcatgagccactgcacctagccctgttttaactttttattgtccacacttataaaattttcacagatctctttcactagtaagcatgattgtaaaacttaaagcagagagtccttttaggctaatctactttgagttctcagagtagctatcatttctaaaacaggcctaaatttttaaaatacaggcttttatctataaaataaataattgtaaaaaacttacgcagaatgagtttgcgtttcttttgctctgagtgaagaaagctactaaggtagaagacaacaggtagaaagagaatgaacacagaaacagcaattacaggcactgtgtcactgcaagggactgaacagttgaaagttcgactccatagttttcgagtgatgttcatctggaacaagagcaaacaatatctttctattttatatttaacttgtcttcaatttcttataattattttgctaataactaaacaggaatctagaatttagactcaatacatacctctaaaaacctactgatagttgaggacaacttcttctgccaggaaaaaaacctggttcaaaatacagtcattgtagaaatttatatccatacagaaatttcatattctaagtccataatactgaccaaagtattctagaatgtcaaccatttgtacattcaaacaaagaacttatatgaagaggaatatagttaggccctgttttattcatttacaaaatatttattatttattgagagcctactagaaaccaggtactgttttaggcaataggaatggagcagtaaaaacaaacaaaaagccacactgtacatttcattttaagtactttttaccatctcgaatattattggttcttatagttccctctgagctgctgtgataattcacacattctcaattcttaagctcattaattctgacctcaagttctctactttgagccaataatttctcagtttcctctaatgccccaaaactccagcatcatagtgcctaaaaaggcatgattgccatctagtggcaccctatgtaaaggcaggctataaaatggagaaaaaaaaattttttttgaccattcaattaatacatgtttattaagcccattatatgctagactgtcctaaatactgtcctaaatactgaatagtgaacaaaaaaagcctaagtccttgtcctcatgtggcttatattttagtgaggaagacagactaaaaataaataaataaatattttcagatggtaatagatataagaaaataaaacaatggaataggaagtgattgaggaatggcttctgaaacatgtagtgaaatccagaaacgtctttttttttttttttttttttttgagacggagtctcgctctgtcgcccaggctggagtgcactggcacgatctcagctcactgcaacctctccctcccggtttcaagcgattctcctgcctcagcctcctgaatagctgggataacaggcgtgtgccactacacccggctaatttttctatttttagtagagacggggtttcaccatgttggtcaggctggtcttgaactcctgacttcgtgatctgcccgcctcagcctcccaaagtactgggattacaggtgtagtcaccgtgcccagctcagaaacttcttaaattagcaacaagtgcacaagaaactgaaatataaacatataacaatacctacacctctgcaaatggcacatattttcaaatttaaaaagattaaaatgtaccaaagcatcaactcacttatgaagtacctaattaatttctgttttatttttatcctaaccatgagactactaaggaaatatccattttggtttaacagaccaggatattctaaaactttactactttataactagttatttttggttgaggacagaatatgcagattccaccctatcaccaaaaataataatcatactgaaggtacattcaataacactctaaaatatgtatcacatcagaagcaaagtacttactgcatcttccacatcaatgcataaatgtgttccaggttcagccttattctcaagttcattcattttttgcatttcactgtacagactactcagagttttgtatgcttcacggcagtttttgcatacttctgaataattttttgtctgtaaaagactatgtgcattcccctaaaatgacaaaggcacatgtaatatatacaataaacattatatacaatatctctttaatgtaagctatttacgcttctagaagacgggaaacaatatggtgtgttaaagtgctaagctgtgatgttgagtaggttactaaatcactctgagtctcagttttatcatctataaaataaaacgacctctacctgtattataagtccgaaggattagagacccggtatgtgaagcagatggcaaactgtttggaactttctaggtgcctctaaattttcaaaactgctgcattagctaatgttaactgaggataacaataattcatatgccaaatgactagtaactaaatacaaaatttcctaaattatctcatcatcacaaaccctcacttatctatcctactctcactgaataaataaaataggttcctgcctatgctgacttgaacaccatagtttatcttactgagacagaactttttaaatggaaagggaaaaggcaccaaaactgcatccccactcaactctcttatcacaaggctcataatccaggcctttctagtcaacaaaaagggccaaataccaaagaattgtataacctaaaatgaggatagtggaggtacataaaatattatgctactaaatctcaatattttgtacttctagactgacacttgtcttttcaagaataagtttgctaaacagtcagttcacacctttgctttctatgccctttattctttactttgtagtatgaagaaagaatattaactgaacattgggatgaaagagaaaagagaaaaatcaaagtaattacactgatgttggcccaacaatgttaccctcaccatctgcttgacagaaaaactaagtctctccttagtctgctacaagaaatagcccattgcttgtttttcacagaacaattgtgcacttagttaaaaattgagcacagggctgggcgcgatggttcacacctgtaaacccagcactttgggaggccgaggtgggcggatcacaaggtcaggagatcgagaccatcctggctaacacggtgaaaccccatctctactaaaaatacaaaacttagccgggcgtggtggcgggcacctgtagtcccagctacttgggaggctgaggcaggagaatggcgtgaacccgggaggcggagcttgcagtgagccgagatcgcgccactgcactctagcccgggtgacagagcgagactccgtctcaaaaaaaaaaaaaaaaattgagcacataatccatttaactaaaattgtgcacataatctagatggggagtaatttaacctttttttttttttttttttttgagacacggtcttgctattttgcccaggctaatttctaactcctgggctcaaatgatcctcccacctcaaccttccaaagtgctgggattacaggcaggtgccaccatacctggccacaatttttattcaaatttaaaatgcacatatcttttaataatgtgaaagttgcagacattaggatgaaatcaccttttgacagaccaagacaaaatagagacaaaaagagtccttgtttccaaagactttctaaaaaccccacaagaaatcctttcacgcccttcattgcaactcctgctttcacatggtttatcactgccattctttaggactgcagtaattcagataagatgcactcaaaagaacacttgcccagtaatggcatcgccaccaatgaactgacaacttggctttgagcctcaggaaccaatgaactcagtttccaagcagcttgtgtgaacctctccctttttgctaataaaagcttccctttacccttccctcactggatgtactggtggtttgccagtgcattccaaattaccatacttctttcttattccctaataaactcatcatatttggagataattttctctagtgtctttttcttaggctgccaatatagtaattctacttctagaaatctaccaaactcatacaagtactctaagttaaatgaaaagaagactgtttatggtgtacaatttaaaacttattatttccagaattttccatttaatatttttggactgcagttggccacaggtaactgaaactgtggaaagtgaagccatatataaaagggatgactttatagaaaaattgctatttgagtgttacaacacacatcagtccactaaaggctctgaagtcctgtagtaaagcatttcccaaccttaatggaatactaaaccctttctgataggacatctattaacatgctgcagaacaaattctgagaaatgttcacctaattttttttattttatttttttgagacagagtctctctgcaacgcccaggctggagtgcaatggcacgatctcaactcactgcaacctctacttcactacaggcgtgcaccaccaagcctggctaagttttgtatttttagtagagacagggtttcaccatattggccaggttgatctcgaactcctgacctcaagtgacctgcctgccttggcctcccaaggtgctgggattataggcatgagatactgcacctggcccaatttttattattctcaaggaaattcataattcagtgttaccacatttattacagaagaaatcatacatgcttataccctaagcatgtgtacatctactatggggattacttacttgttatgtaagtttcaaaactacattttaaccagagttccaacctcgtccttcaccacgaccgggcaagttccaataccaaaattcaagagtcagagatagagatggcaataatctacaaggttaagattcttaaagctaccttttattatcataattcaatactcaaagttatcttactaaacagtgctttttaaggtaggtaaaacatacttaagcaaatttcaggcaaagaataaacttcctatagacagaatcatactacactgcaaaatacctacgtaagtcagattgaaaaccattgtgttttaattaaacaatcacacacctcaatcaatgttttcacaatcattatctcaccagattctcattacaaaatactttaagataggcaggatagatattatctccattttacaatgagagaactgaggttttcatgatttgtaagtagaagaacttacttaagagcagaaatccaggtccactaactcctttacatcatgaatttagataaatatcaataattagtgctctaaaaacttggaactgcacattattcctttgtacaaggcagcattttaattttaaatattatatataaaatacctgaaggttatgttcaaagcaggtcagggtgtgattaaatagattaaggaaatatactgtgctgtttgataattcttcactgttgtttgttaaacaatctgtcaaaaaaattcaaaaagtatattaatataactcaaggaacaattctatgttgtcatttatatcttaagctatcagcttcgtttcacactacagtaattctttattcaaacaagcatgaattttccaaatatatgaagcttactccttttattttccaaaagttaaaaaagtcataaccattttcatgaacatgttaaaataatcacatactctcttttcataaaaatataccaaataaaattcaaatggacttttgatggcacaaggtcataatcacggaatatcagctatcaaatgctgccttaacagtgctatttaggcataagactgtttaccctgcattaattttaccgaaactcatatgccttatcattttttgtgtcaaatttcatagttctctgcatcttccaacttcactaatgagtcatttattgtacctaatggggtaacttttaaaattcgctctttctaatccatcacgagttgggagcccagagaaacaaactggtgagaattttgcctaaaatactgacgtgggggcttcaagtaaagtctagaaacaaaattgttttacatttttaaaaatcctacataaatggtatttctctgcaactggctattcttgcttagagttagctcaagttcactcatcccttttattttctatgtatgtgtatatcacaatttatgtatccattttcccttcttcagggaataatctattcttctttttttttttaagaaacggggtcttgctcggttgcccaggctggagtgcagtggcacaatttgccagctcattgcagacttgaactcctgggcgcaagtgatgttcccacctcaaccttccaaagtgctgggattacttaaaggcatgagccactgcgctcagccagggaacctagtctttatcctcaggtaaacctttgtctttacctctccttgtgttctcagcctgctatctccaatcgaggttcaactgcctggttccagatcttggaacttgtggtcagtcgtttccatctgactctcctagaatccttgccctctttatcttccacatattcacagccattttcatccctggacagtccccatctactttctgtactctcagtctggttacagaatactactacagaaattctaaaatgataatgaagggactcaattcaaattcatgtgttctgatctcggggcaacaaaatgatccttgtagatgccctcctaattgctctgcaagggatgttccacatattttctcatctctagtcccagccctactcttgttccccttaatttcaacagatggctttgtattatgcccaccttatttagaaattcagggccatcagataggatctctctcaactggaagtggaaagacaacatgcaaagctattgcaattacccaggagaaaggcagcaaggcaagtagaatttgtggagaaaagagagacggactaggtagacactaggatatgacacactaagggacatccatgtactctgacagacaacaattactacaacgaaagttaacacttactaaatacttgctatgttctaagaactatgcttacactgcactttaaacacatttgcccatttaattcttgcagtgattccatgagggaaaaattatcattatctccattttataaataaggaacagagataggtttagataaattaaggaagttgcccaaggacataaaactggtaagtaaaaagctagactctgtactcagtctgattcttgagcctgcactctcaaacactgcaaaataaacatatttatatctacattctaaaccattaaaagttcaagactcggaatctacaaatacatgccactgcctactccctccactacccatagatatcttacaccatacagggattcaggcagtccccaccaactgatcagagttagcaactgagatgaaacctaaacctggtagacaggggcagacagcacagtaaagctcctttgtgcaaatcagaaaaagatattccctctgggtagataaattacaaaaggtcattcctgcctccagaagctaagctggaattcagccccattcacctccttgtacagcccccttgtgcagggctccttctgcacccattgtacacaggatcctcttggtaaacctatttcaggagttgtcccctctctgaactcacatactctacattctctgaagctttatcttctccagaacatgaatctcattctaacttctcacccttatttaaaaaatctgagggatcactacaaattaggaaactaagccacagaaataggtgatatgctgatgatcataccacaagttaataagccattgatataaaaataggccagcatggtggttcacacctgtaatcccagcattttgggaggcaggtggattgcctgagtccaggagttcgagaccagcctgggcaacatggtgaaaacctgtctctacaaataatacaaaattagccaggcatggtggcgtgcatctgtggtcccagcggcttgggaggctgagaggggagaattgcttcagcttggggaggtcgaggctgcaataagctgtgattgcgccactgcattccaacctgcatgaaagagtaagaacttgtctcattgcccctcttaatgctagtttaatatcatcatgaagtagcccgcaatccttttagggatgaggcagagttgatataaataaaaacaaacaattacatagtttttgtacatgtttacaaaaacaattatatagtttttgtagttgatgtgttgcagggaagttaagggaacacaatttcattcacaacagttgtacatctgtgttataatgagctatgtcgtgacaactgacataacaatatagggataaaaggggtccacatactgccagcaaaagtagtataaagtgcattatcatgagagagcaatagcaaatttcttctatgcaagatacctaattaaaacaaataatttcttttgcaaaagcaatttataaagaaagcttctctgaagaacaaaagaacttaatttcttttattaataattacattaatgcattaccatcaaaactttttcaatgatcattagatggtggtaacataaagcataaagcagttcatttatataatggggttaaaaagtcttcattattaaaaagccatgactttctgaatcgaaataacagatctctagtaaattccttttttatctttttgcaggaattgggagcttaagattataaacagtgagaagctgtatgttttagaaattggtgagttaaagaatattaataataataaagcttcctttaagcactaagtgaagtggtcattatgaatttccttcatcttagataatcaatggagcctcatcaagggcagattagcagagtggctttctcagagaaggctcaggcatcagcttaagagtcaatctttttttttttttttttttttctgagacagaagaatctcactgtcacccaggctggagtgcactggcataatctcagctcattgcagcctccaatgtgcctggcctcaagaggcattcttaaaggtattaaggattcaagttaagacctcacagagaaacctactaaattatcataacaggaattatgcatctttaaataaagcatttggcatctcttaggaattttacaaagatctttgctgtttttcaaaactagttttatagaaaatagcagagataatcaccaatttagggtaagcttcagaaaataaaaataaactacggcaactttgtacctaaatgacctaattaagtttaacaaatatgaaaactaagatactttaaattataagatacaaataatatgattataacgcttagtacatttccctctggataaaatatgggaaagaaaggttttgggccgggcgcagtggctcacgcctgtaatcccagcactttgggaggccgaggcaggtggatcacgaggtcaggagatcgagaccacggtgaaaccccgtctcaactaaaaatacaaaaaaagttagccgggcgtggtggtgggcacctgtagtcccagctactcaggaggctgaggcaggagaatggcgtgaacctgggaggcggagcttgcagtgaactgagatcgcaccactgcactccggcctgggtgacagagcaagactccgtcttaaaaaaaaaaaaatgttttggttaattgaccttctggttaatcattaagtactattgttgttgctttttaaagcatcaagacatacattgtatgtgttaactgaaagttagttttcctctgatgaatcagaatatacatcgggattacacagtggttcaacagcatcattatgctcattaattatcacccagatcacctgtatcactgaagatataggttgctcataaagaaagagttttcagtgtgtaagaacaaatatctgaactgataattttgaggcctatctcattataataatgcttcatactggatactgcttaccaaagaaccaaaacactaaagcagtcatgaactcatcaaatctggtcattctgctgattatttaactgctgtatgcacaagataagcaagaagggtctcaataacaaggctatccctatgtcaacaatacacacctttaaaattctgagaaacctttaatatactctctttactttttggcagtcattctccatcagaaacagctagtttccatgttatttgtagtatgagtagaaaaagttgcactcttaacacttcttttgaccttccatcaatttccaataaccagattcctaccaagactaataccatttgaagacacaggaattctgagaagaaaagggatgggagtagtacatggatggcattctctcctctcttggattcctagccttcctttcatgaataataactgcagagactagatgccacccctatttcaagctaaattaagcagaacagaaagatagttttgggcagtatactcattttaataatattctttctagtaatattttacctttcatgtttttacatttttttctgttatttaataatattattttacaaaaattctaatagcccctgttatggtctgaatgtgtctcccaaaattgatatgttgaaacttgatggccaatacaataatatcaagaagtgaggcctttaggaagtgactaggtcatgagggttccttcttcacaaatgggatttactcttccacttttctgccacataaatgggatgatgaatgatgataatttttaatgcgtaattctggaaaatgaaatagctaatctctctaaccacatctaacatacaaatactcatcacagatttgaacattctgttaaattttttaaatttctatatatttttgaatacatattaaatgtatatggcataaaatccaaagggtacaaatgcaaatacggtgaaaactaaatcttcctttctttcctgcccacacagctatccaactgccctccctcaaaatacatatgtatttttagaacacaaaatatcatacttctctgtacctcgcttcttttacctgagaccatatgtctgggccaaattaattttaattgggaagagtcttttaagtaagtcatatctaattgcttagcattttatttggtcctcagaagttcaatgtaaggaatattttcaagataggatgcctcacagaagaacaaaataccctaagaatttattctaaagcattttatacctgccatactgagtatgcggtaaaacgttttcttttcaactaactggggaaaaaaggtctgtacttcgaattagtgaaatcttttttacaaaacaccttttaagccaggcacagtggctcacactttcaatctcagcactttgggaggccaaggaaggaggattgcttgagtctaggaatccgagaccagcctgggcaacatgacaaaacagcatctctattaaaaacacaaaaattggccaggcatcctcgtgctgcctgtagccccagctgcttgggaggctgaggctggaggatcacttgagccctcaagaggtggaggctacagtgagctgagattgtgccactgtattccagcctgggcaacagagcaagactctgtctcaaaaatcaaacaaacaaaaacactttttaaagaaaaaaaatgccctgcctcttctaagtatataaatttagtcacatctgtcaaaagaagtgaacccctggctcatctgaaggtagtgagttatctcaattaattgttcacagttggttacagatcgaactccttgttctactctttcccctcttctcactgctgcacttgactagtcttaaaataaaattaaaaaataaagaagtgaatcccagtatatatccacttattccaattaactgattttaaattatttataattaacatatttttctatgttaatggatttttctaaaaagcttaagaatacttaaaaacaggtctacatatgttaagcaaatgctcttcaatcatatttatactagaaaattttactctgaaaagtaaaggatatgctaaaaaaaaaagttgtgttagtcaagcttcggaaacaaaattttaaaagtcagtattcaatataccatagtatactgacaagggaaaaaaactggctggggcttcttatcccattttagtttttcttcatatgaactaaacaaaaagacaagtcttgataaaagctaagctacttaatgacttataggtacacaaatttttaatctatccttctatttccaaggcccctccctacttcacattttctttccttcttgcctaaactatagcagtaaacttcttactggtctctctctcttccaatgaggttccatgaaaaaaggatctttgtagtttttttttttttttaaaggcttagaaagtgctaggttaaatgatgtttaaaaaacctttttctttaagacagggtcttgctctgttgcctaggctggagtgcagtggcacagtcatagctcaatgtggcctccaactcctgggctcaagcactcctcttacctcagcctcccaggcagctgggactataggcatttgccaccatgcccagctaatttttttcttttcttttcttttctttgtagagactctgtctctacaaaaaatgttgcccaggctggtcttgaactcctgggctcaagcaatactaccatcttgtcctcctgaagtgctgggattacaggtgtgagcctccccactgagccaaaaaaaaacccttttaaaaaaatctcaatgcatttaatattccaggtgcattgtaaatcccaaagatactacaacatacagtagtcaactcttatcttcaagggatatattccaagactcccaatggatgcttgaaaccaagtatagtaccaaaccttctatatactacgtttttttctatttctatgtttttttttctagtatagtaccaaaccttctatatactatggttttttctgttttctatatcatacccatgataaagtttaatttataaattaggcacagtaagagattaaaaacaaaaactaataattatgttactattattaaagaattagtaagtaaactaagggttacctgaacacaagtagtgccataccatgacagttgaccttataaccaagatgctcctgagtgcctcacaggaggggcagcatctacagtatagatatgctgcacaaatggatgattcgcagcccaagtagatgaagcaggatggcatgggatttcattatgctactcagaatcatacacaatttaagattataaatggtttacttctgaaattttccatttaatatttttggactgcagttgactgcagtaactgaaactacagcaagtgaaaccatggctaatagaatactatataatcataataggagaatactatataagcttttcttttctttttttttttttttttgttattgttgttgtagatagggtctcgttctgttgcccagagcggggagcagtggcacaaccatgattcattgcagccttgacctcccatctcagcctcccaagttgctgggactacaggcacatgccaccaagtccagttaattttttattttttgttgagacaaagttttgccatgttgcctaagctggtcttgaactcctaggctcaaacaattctcccaccttggcctcccaaagtgctgggattacaggtgtgagccaccatgcctggtctataaccccttcttaataatatgctgatattctaagcagtataaaaaatgttggcccaaatagtatactactctgtcagtcaaggtcctactttcccttgctaactttacctcccactatgcttcctggaacatctgttgcccttttatacctctgtgactacctgcaatgtccttctctcatttctacttttttttttttttaagacagggtcttgctctgttgcccaggctggaatgcagtggcacaatcatatctcactgcatccttgaattcctgggctgaagggatcctcctgccttagcctcccaagtggctaggactacagtcacacaccaccatgtccatctaatttaaaaaatatatatttttgtagagatgggggtctcactatgttccccaggctggtctcaaactcctgggctcaagcaattctgccttggcttcccaaagtgctgggattacaggcgtgagccgcctcactggcgtcatctctacttattgaaatcatgtccaatagtacaggcctaggttcaaaaggtagctcctccaggaagtcatttcaaattctccccagtaagatttattttcttcttcctccaaggactctataactttattaaagcatttatgtgtctgtcctaggctgtatttgtaaatatatctttctcactcattaaattataagacttgaaaaataagaactgcctagcacatagttggtattcaaaacatcatctgaattggaagtgattttaatttttccaaagaatatctaaaaatagatcttattttattacacaattacacacaaacctgcaaagaaggtagaacagatgtcatcatcccaccccgccgcctgccacacaccacttgacagattactgtaaacatcataattattattatactaaacagttaacatttcttgaacactaaatacgtgtcaggcattgagctaagtgctttacacaatttatttcatttcattctcaaggcgactatataagataggttctatcattaccaccaatttacagatgaagaaactgaacttccaagaggcaaagtttttctcccatatctgacagctagtaggttagggctagtaagtggcagagcttagaatcaaacccaagtctatctaaatccaaagctcatagtaactgctacacttttctgcctttcgctatttgctcagttgccattaataaaccatggtgtccatgacagtttatttaaacttagcaataaaaagtattatccagcttcaaagatcccaaaattcactaaaataaaatctgacatctgtactactgaaccataactgcaacatgaaaatgaaagaattacttacttgcacaatttgcctcctgccatgtggtattaaaaaattctgagagaatcacaactatttgcattctatctgccattaagagacttctggcacaactctgactctctgaagtattctgtaacaaaaagaagacagaaaaatacaatctgagtattttcagactttgcaaacaacttgaggcaaaaaccttacaaaaataacatttattataagctttttaacattttgtttgatatgatcagatgttaacattaataaaaacaatgataataaagtaattagcagctaacatttattggtactaggttcacttgcaaaggaagaaaatctttgttatctaaatagtttgtacccagatggaaaaatatgcttttgtagatcattttaataatgaaagaaactcatgctatgcaaataataaatccaagttcccaaatcatttgatccttatctatttcctttccttcgtgccccaagcaaggaactaagtcctgctgacccttaattctttcaaagttatttaactcctactatttactaggcactataaaaatcctgaagttctgaggatataaaaagtataaaagaatgccatcaattctggggctttgagaacctctcgcagttacacagacaaggagttatacagtgtgatgaataataaaagagtggtaactcctgggaaacaaatggtcagtcatgtgggagaagaaatggaaaaaaggagaaaagagggagaaaaggaagaatttctgctttaaaatataaaatccaagcgattctcatgccacagcctcccaggtagctgggactacaggcacatgccaccacacccagctaatttttgtgtttgtagtagagacggggtttcactatgttggccaggctgatcttgaactcctgaactcaaatgatccatccacctcggcctcccaaagtgctgggattataggcatgagccactgcacctggccatgaacagaacattttaaaactcttttttagaattaccttctgagcaataccagccatagaagaaaattttctattatcacttttttttttttttttttgagatggagtctcactctatcgcccaggctggagtgcagtgacgcaatctcagctcactgcaacatctgcctcctgggttcaagcgatcctcctgccttagccgcccgagcagctgggactacaggcacatgccaccatgcttggctaatttttatttttagtacagacggggtttcaccatgttggcctgactggtctcgaactcctgacctcagacgatccacctgcctcggcctcccaaagtgctgggattacaggcatgagccaccatgcctggcctattatcacttcttaagtagaagtaataatattgtattaatacaagcctgggtcactagctagtgaccttgggcagctgacccaacctcgctaaggttcagtttcaaaatcaggggtcctacagttactgtattaaatgaaatagcatacattaatcactcagcacactgtctggcacacagtgactgatatatgctatttcacctagctaccatgctgccaacctgaagtgctctaagtaggtttagttggataagtgtcattagttggttaagttgaatcttcataagtgggtgactggctattttaaaaatcaatacagtagagcctgtatgagtgttcaatgtgtggaacagttcggttcaggaagatatcaatgtagttttgagaaattaggaaagagttcatgaaggaagcaggatatgaactaagccctatattgaggaagagaagaggattcgaaaatagaagaattaaatgatcatggggtgaaagtgataatgattatgtggtattcggagagtattcagtagtctatgaaagtagggctattaaagggctaagttagaacaaggttatgagaggccgtgagggtcatgagagttagccagtgagaaattctttaagatttatgaggagggtgtcatgaaaagcagtttgaggaatacatctttaggccgtgatatgtagggtgaggaggcagggagactcattacactacttccatagatcaggtataatgaaaggatgatggcaacagtgaggacagaaaggaaatgattaataatccaaacgatgatgaggtacttactacttaccagttccaaatgttccaacttccttatttaatcctcataacaactctatgaaataggtagtgttagctgggtagagggtaaactatcagaggtgactgagaaggaagaattggagagataaagaaaaataaggagagcatgatgtcctgtaaatcaaggaaaagggaaggggtggttatttgtgtcaaatcctgctgagagaactggaggtacatctgtcaacactggcagtattggtgacactaacaagaatgaatttgatggagtccttgagtgtgaaagtgagatcagagtgggttgaacagggaatggaagatgaggacatgggaagagtgaacctagacaactgctgaagagtttggccttgatggggagataagaaagagaggtcactaaagagcaatgtgggacccatgcgtcattaccctgatgcatggtttcttaaagcatgatatccacctatatatgtttaggtttctcttctggacagatgtccctttaaaatggaaactgtcacatctttgtattcccaacacctcgccaagtgaccaaaaaatcaatggtccttgcttatacttagaactcttaatactcaaatctatcctaactacttagcagaaccctaaccatcttgaagccagccatttcctttgatcatgcctgcacccaggaagtcaggagctgctggcaaaaaattaacaacacagattaattccaaagtaaatccataatcccaaaccgtactcctcacttttctgtctgctcattctctcctttttacaaccgctatttcaaatcctctccactctcccagaaactctgatctctctcccactctttactctcaaaagaagatctagcctcctggataacagaagccttcgagctgaaactctaacctgcctacccctacatgcaacctctccttctaccctcccattaaggtggggaaggcacctgtccttttcaaggcccatctctctgaggatgccctagatcccatctatcctgccttttctggaaactgaccttgtctgcttcccactccctcctacagaatcttcactttctctaaaggacccttactatcaacatttaaacatgtccagctctctcccatcttggacaaggaagaagggaaggcaggacagaggaatggagggacaggggaatggaaagaaatgatagaaagtcagcctggcaccgtggctcacgcctgtatcccaatactttgggaggccgaggcaggcagatcacctaaggtcaggagttcgagaccagtccagccaacctggtgaaaccccatctctactaaaagtataaaattagctgggtgtggtggtgcacacccatagtcccagctactcaggaggctgaggctggagaatcgcttgaacctgggatggtggaggttgcagtgagccgagattgtgccatgcactccagcttggttgacagagcgagcctctgtctaaaaaaaaaaaaaaaaaaaaaaatagagaaagagaaatgaaagaaagtctctgagtcccacattgctctttagtgacttctctttcttatctccccatcaaggccaaactcttcagcagttgtctaggttcactcttcccatgtcctcatcttccaatccctgttcaacccactctgatctcactttcgtacccaaggactccatcaaattcactcttgttagtgtcaccaatactgccagtgttgacagatatatctccaattctctcagcaggatttgacacaaataaccaccccttcccttttccttgatttacagggcatcatgctctcctcattcttctttatctctccaattcttccttctcagtcacctttgagagtttaccctctatttaatcttaaactcttagtgttcctactcattcttcaggtatgttcacccatgtcataatttcaaatgccatttttatgccgacactcccaaaggtgttatctctagtccagtcctctagatgtgtatattcaaccacataggcaatcaatatatccacttagaaagctcataaacacctcaaaatcaacacgttcaaaactgagttaatgatcttcgcccactaaacagactcctccctccagctcagtaaatgacaaccctattcattaagctgctcttattaaaaccctggaaatcatcactaccttttccttactccccacattcaattaacctccaagcctgtaatttctgcctcctaagtatctctgaaatccacccatttctccacatcatgatggcccccacatagcctagacaccactgtctctcacaccactgcaacagtctcctaattcatctccccacatatcttcttcccctaccctccccagcccctaccctctccattttctgtcacatagccagcatagccttttaaagtacaaatctgattatgtcattccacagaattaaacctttcactaacgtcatactgctttaaaatcaaagtctaaaatccttaacataccctacaaggcccacatgacctggcacctgtgtacttccttaggctcagaccacgggtttccttcttgctcactgtgctgtgttctagacctcagatacaccacaaactccttcccatctcagtcttcatgcctgctatttctttacatgtataccttccctcccctgcctgtgttctctcaaattgtaggtgtctgctttaatcactgaccattctacctaccccccagtcatactcaagatcagcactcttgtcatatgcattggtagcatctgggttttttaatcagcaacacttatcacacatgaattaaataattatttgtataatgagatgcttaatgtctgtcttcagactacaagctctgctcattcatgctatatccctagtagctaccacaacctgtacataataggtactcaataatttttttgaatgaatgcagaagaaatattacattttctgatctctaatgaaagacacagattattacactatgttctggctttctccctatagtcctcagaattcattatttaataatctacagtaaaagtatattgaatactcaccaaatacataacccaaatgactagcacttcacaaagatacacagatacatagatagatagagatagataggtagatggatggatctatagatctaaattttaaacactatctaaattttaaacaaaccaagtagaataggacagagcctaccaattcagaatctgagggggcaaaagcatcctcaggaccattccgataatgctgaatcacaatgaaactatgtccctatcagtttaaactaaaaggagaaagtatgactctaaggaagagggaatccctcagttctatcattcaggtttcagaaatcactgtatttttcaccttgagataatgaaactatatgcgatccctctcccagaaattctaaaaggaagtgacaagaacctaggattcttatcagggaattctattatagttaaactaattatattgctgtaccacataaatagcttactagtttctggctttgattctttttttctccttattatactcctctcctctctcaatcaatccatgtccattcacactaaagaagggtagaaagaatgccttgagattcagcttgtaggtttcccctgatgaaccagccttgctctgttccgtcattttttttttctttttttgagatggagtcttgctctgtcacccaggctggagtgcagtggtgcaaacttggttcactgaaacctcagcctcccaggctcaagtgattctcccacctcagcctcctgagtagctgggattacaggcacatgccactactcctggctaattttttatatttttagtagagacggggttttgccatgttggctaggctggtctcaaactcctggcctcaagcgatccacctgcctcggcttcccaaagtgctgggattacaggcatgagccactgcatctggctctgttccctcctttaacttggcattcctttcactcttttgttctaaattgctatggtacaatttataacactcactgatattttcctatttccccatataaggtattttatttcccctaactatactgatagtttgaggcctgaatcttacccttcttttccttcttatccttttaccagcccaatattcaagaatagtaggtgcttgctaaaaactgatttcaataaaagactgagtctgagtcaaacaaaatacattacactggataggctgggcgtggtggctcacgcctgtaatcccagcactctgggaggccgagccgggtggaccacctgaggtcaggagtttgagaccagcctggccaacatagtgaaaccctgtctctactaaaaatacaaaaattagccaggcgtggtggtgggcgcctgtaatcccagctacttgggaggctgaggcaggagaatcgcttgaacctgggaggcgaaggttgcagtgagccgagatcccgccattgcactccagcctgggtaacaagagggaaactccgtctcaaaaaaaaaaaaaaagggctgggtgtggtggctcacacctgtaatcccagcactttgggaggtcgaggtgtgcagatcacgaggtcaggagattgagaccatcctggctaacacggtgaaaccccgtctttactaaaaatataaaaaatcagccgggcgtggtggcgggcgcctgtagtcccagctgcttgggaggctaaggcaggagaatggcatgaacctgggaggtggagcttgcagtgagctgagattatgccactgcactccagcctgggcaacagagcaagactctgtctcaaaaaaaaaagaaaaagaaaagaaaatatactacactggataaataaacctccccaagagacaactaattccttcaagttcactcatgacacatttttccataggtttttgttttgttttgttttggtttttttttgcaacggagtcttactctgtcccccaggttggagagtggtggcactatcttggctcactgcaacctccacctcccgggttcaagcaattctcctgcctcagcctcctgagtagctgcgcaccaccacacccggctaattttttttttttttttttttttttgtatttttagtagaggcagggtttcaccatgttggccaggctggtctcgaactcctggcctcaggtgatctgcctgccttggcctcccaaagtgctgggattacagacacgagccaccacacctggcctcataagttcattattatacatgatggttcaactcccaaaccagtccatatagccttttaaatctataaagtacctcagaactgtagatgtcacacttttgagctaatgaatcatatccagctctactggggaaataaggcgagccgagaccaaggcctaggatgagttggagagaaaatacaaaaaaagtttccctgcctcttttcacctgtttatccacttcctttcacatcagggtgagttgagctgggtacccaggttgctggtagaatctgagggaaaggaagggggtttctacaactcccccactgggaagcctcctttgggtagtggggaattcatatggaaattcacatgcagattgggtgatgcccataatactgcaccctagagtttgaggtgctatttttagcctctctttaattccacagtacctacacacatgagaaaagcatttgctgccttcaaagacccaaactttgcatcatgatccctggccattctgcccacaatagcccttgttctttagagtaaatggaaccctaaaacaactcatcttaaccactcaacactgaatatgatgctatatcgtatcctgctgtagttgacagggacatgtcttgggtactttattttaaagtgatagtaagatatatattccttgctatacccaatggaagtgtgcctggaaaataccgcatgtaagcctgaatttatttacctcgaaaatatgtccttggccaggtgtggtggctcacacctgtaatcccaaatctttgggaggctgaggtgggtggattacttgaggccaggagttcgagaacagcctggtcaacatggtgaaacctgtctctactaaaaatacaataattagttaggtgtggcagtgcacatctgtagttccagctactcaggaagctgaggcaggagaatcacttgaacccaggaggcggagattgcagtgagccgagatgacaccactgaactccatccagcctgggcaacagagcaagaccttgtctcagaaaaaaaagaaaaaagaaaaaaaaaaaaacatgctctttacagagagattgaccacagaatttatttaatgcaaataaattccccagttatgtaaaatgacagatttttattttatttttatttatttatttattgtgagatggagtctcactctgttgcccaggaaggagtgcagtagtgcaatcttggctcaccccaaccttggccttccaggctcaagtgattcttctgcctcagcttcccgagtagctggaactacagacgtgtaccgcaattcttctgcctcagcttccagagcagctgggactacaggcacgtgccaccacgcccggataatttttgtatttttagtagagacgggggtttcaccatgttggccacgctagtctccaactcctgacctcaggtgatccccctgcctcagcctcccaaagtgctgggattacaggcatgagccaccgcacacagccatgacagatttattttaaataacaggctgacttaaagcaggatccaactaggtacaaatttatatttagtgcaactataaacaagtttagacaagtttaaatttatggaataattccaaccacattttcatgagactacttgctgtccccgtaatacaagaggaactttctcattctccaatcccaatgttattcctcatgtttttcctttaccaagcatatccggcccacacctcgtgactcccaccaaccctgacactctaatcttttcctagtctaaactttataaagtacttaggagcaggaattgtctgtttttctttttaaaattaagtgcctcacagcagctaccacacacctagagaacccttaaggtatgaagaatgaagagcagtcttacaatttcttaaaaatttacctcccatttacttagaggtattactatgtgttgttttctaaaacctccttttatccccattttacagattagtaaacaggcacagagaatgtaagtaacttgcccatagtataccgctaataagcagagtggaactggagtcctggccgctagctagctccagactgttcacatcactaagatgaagtcacaggcaatatctcttttaattcttccaacagccgcattaggcagatgttctttccactttatagaggaggaaactaaggttctgagaagataattaatccaaggttacatagttagaagttggtggacatgaacatttctggctacaaagctcaaatttctaaccactaccagtgtctccaccccacttgtttcagaaaaggatccttcctggcaactccaggtgaagatgagaagaagccgtggtggagtgggtggaggaagagcaagagggttggggaatcaggacccccaagaaaaccaatcacacctatatgaaccaaagatgtccaacagcattcttggaagcaaaaacccaaatcccaagccccataatgccaccccctttttctgatgacccaactctacagactcagtccaacccctttttcttactgttggggaaactgaggcccccagcgctgaccatcattacaccctcctcctttcccaactctcctgagccacagtcccggacgtggtcctgtacccacccccgcggctcggctgatgttgtccatcttgctgacgacctgttggaagagggggtagcaggtctgacagaggcgcacgggccgggcgctgcgcaccagacaccctgtcagctctgcgctgctgttggcgaagtccagcaggagctcccggcactcaggatccagatccggcaggtccgggggcagcgacagaggccccagccctccaccctgcaggagggacagggacaagtcctccacctccagcaactgctgctccgacaggaggtcgtggaagaccctgtgcggactgctgccgaaggggagcgcgcccagggccagccccgaccacagcagcagccccagcggcagccacggcggcaacgaacacctccgctgcgcggctgtcgggcccggctccatcaccgggctcacacaccccagggagcccaccgccgcctctccgcccccagccggcaccgcggacagccgccgcttccggtttccgc

SEQ ID NO: 1901 - DNA, 29063 bp, Homo sapiens
ttgtatggaaacatttgactttatttaatattgagacaatacatatagttctgattaagagcatcagaaactctgaatcaagtgtattcttcttggtcaagagcttaataaaagtccctctcttaaaggctcatcttgataggaatagaaacaaaaggttaccccatagttctcttacatttggaagttagctatatagagggtacaaggatattcattttccttcaggacaaagtcatctctgtacgccctttattgttgaattgcagtttgatttaggggattagaggtggtatggtaccagtaattgagtaatggtggaaatgtgaaagtcagtcacaggactctcattggtgccagtgtcatagttaagaaagaaagaaagaaagttttatatatcctgtaatctagactggaagctaaataattgctaggaagcaaacttaagtgatagctgttaagttttttggtttgtttttgaccagagatgatgaagtaggtgatcttttcttggtttgctcctagactcttccattttaacttatatttttagtttggtgcaaaagtaattgctgtttgggaccatgaattttaagtcattataactaggttcacacaaatctttattaattaaaataggaaccattacaatcaacacatttttgccaatgagaaataagtttgtttactcctgtagcataaaaatccatgcttccaaatttgacgaactcttggaaagcattttctgtgtcctgctagttgtggaagcaatttccctgcaaaacgttgctgagatgcctaaagaagtggtagtttgttggcaagaggtcaggtgaatatggcagatgaggcaaaacttcatagcccaattagttcaattttcgaagcgttggttgtgcaacgtgcggcccagtgttgtcgtgaaaagaattgggccctttctggtggccaatgccggctgcaggcattgcagtttttggtgcatctcattgatttgctgagcatacttatcagatgtaatggtttcacctggattcagaaagctgtagtggatcagactggcagcaaaccaccaaacaatgaccatgaccattttttggagcaagtttggctttgggaagtgctttggagcttctttcagtccagccactgagctggtcatcgccagttgtcgtataaaatccaccttttggcacacatcacaatccgatagagaaatgattcattattgttgcatagaatagagaaaatgacacttcaaaacaacgaatttttttatttttcactcagctcatgaggcacccatttattgagctttttcaccttttcaatttgcttcaaatgccgaacgaccataaaatggtcaacattgagttcttgggcagctctcttatagttgtaagaggatcagcttcgatgatgttctcaattggtcattatcaatttccgatgactggccactgcactcctcatcttcaaggctctagtctcctttgcaaaacttcttgagccatcacggcactgtatgttcattagcagttcctgggccaaatgcattgttgatgttgtgtgttgtctctgctgctttataacctattttgaactcagaaaatcgctaaatttgatttttgtctaacatcatttccatagtctaaaataaatataaacagcaataagtcattagcaaaaaaaaagtgagaaatatgcttaaaatgatgtataacataaccacatttatttaagaatgtactccaatataaaacggcaaatttcaacaatgcaaaaaccgcaattacgtttgcaccaacctaatattttcctttttcaggattttactttaaaataagcaataagcttgagagcacatagaagaaaataagctggattttgcatctgcttgacccactaggaaactagtgatattaaattattaggtaaacaatgaaagtttctgagcaacatctgatcttagaaggcaaactccatttgttaatatgacagattgtaattctgcttcctaagtcttcatgatttcttccttctgtctagttcattgcttattttcattctttagtgtggaattgtatctgtgattctgcccaagttcaaccaacctgttctctcttatctttctctagacagaatgatgtctgtagctgtgtttgtgtaattcaggtggcttctcaaactagcctcttaatacccaaattattagtctttatatttagttgacagagttttcacataccttctcatttgacttctctactaaaaggtagttttagactgtcccattttataagtgaggaacctttgtatatcctgcccaagggtgccgtaagtatggcagagccagcacactaactcaattcctttgactccaggtccagctttcctccctatgttgtttagcacaacccagaaggagacagcagtgtctcctgagggatcccttcctttctctgtgatgcagtactgacagtaattattcactttggacactgctaccatcatggcaaatttaggccatttagataaaagggaattaactaattataataaaaggggatatattatgaaatgtataaagcactttgttccttttttctgtagtaattttgtgacctagtccttggttacagtagtgagggttcagaaacctgggagctttttgagtaaatacaaagcacaacataaaacttttatgtttgactctattcctgttcaaagctatttctgttaactaagcttatctgcgcattctagttgggaactattactacaatgttagactgctccatgtaaaactaataaatggcagtaaaaggtctcagaagcaccaagggttttgatcaggtcaggagttagaaacttaatgtcatttgtattcatttcttgaccaattgccaaagtttatatatttttaatttttctaacataccacattgtctgttgtattaataccagttcactttttgttttctgcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatataggtaagtcatctaataatctttcttaagactctgcaatggaaaaactggttgtataaagtcttctctgccctctccatttgtatcagcaatggggaatgctgcaaaacatcatcttgctcatgtgatggtgatggcaaagatatcacaaggagttggtaataagatttaattttccagtagcctgcatgaattgttccccacataaaactgtacagttagtgactgaattgtatacttaagtcccagtattttacattagtgagactgaaattagaggtaaatttctttaacaagtgtaaggcttacctatttataaagaattattctgttagtgtttaagaaaaacagatctagagacaatccagtaggctgcattgtaaacattatgattataaatctcttagtactgccattattattgacagttttgtaaagacttgtaaaaagtccagtttctcaggaatatgaaaattatcttcagaaacctggttggggcctttctccaattcctccagccagctgaaatactgccaagctcacttcatgtgcaaggtgatctgcactttcctgcaaattacattaaaagagattagatgagaaagacatagcatgtgtctaacatgggcaagaccatgttacttggaactctggggaagagaggggtgattcttgattttgtttcactaacaaattctaatgaaaaccttttttcatctttcagtaacaaattccaaagcccttaaataaacggaaaacagaccaaattcttctaaataaggtaagtttttaatcaattcagattataaaaatagctatcattccacaactgaaaaaattcaataaaactttaatccacaattggcctaacagtaagtaagtactaatgcctctgttgccatctcctcatccatcatggatattcattagactctgagatggcttaagcttctgcaggaaagctgccaaatgtctcctcctgattccctattcagcgcactcactgtactttgccctggctttgcacacactttaaggagtatgtgaagaggccaaataataaaaatccagaccacaagtcttgacccctgtcagggaaacaggcacagagtaaggctgtcatttaaaggaaatattttgaaaaacaaatcaagagtccagaatgctatcagttgacttagaaatgaactacaaagctggttgttttcatgtcacaagagtatatttttaaaagaagagaaaaggatcatctaccttatagtgcataaactaagtatttattagttattcctgccatggttaaaaatatgacactttcaggaagtctagaataagtcaaaaatatttggggaaataaactaagtgggtctaattttgttaaattgtataattactgctggtgaaaataattttgtagtcttaatgtgaacctaaaaggctcaacaaaataaagccttaatcatcatagtgagattctaaaaaccattaaaatagtttgcctgcccatcacctaatattaggctctttttcaatagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgatgcgtcattcatattatttattatatcataaagttggaaaccaaatacttcacagacaatagaatgttaagtaaatgaacttagttattctataatttttttttcagctgtaagagaatacaattaggtatcataaggccttctttttttgttttgagacggagtctcgctctgtcgccaggccagagtgcaatggcataatctcggctcactgcaacctctgcctcccaggttcaagtgattctcctgcctcagcctcccaagtagctgggactacaggtgtgtgccaccacgcccagctaatttttgtatttttagtagacagggttttaccatgttggccaggctggtctcaatcccttgacctcatgatccgcccgctttggcctcccaaagtgctgggattaaaggcatgagccacgagctactgcgcttggcccataaggccttattttctatgtatcatatgtgtatgtacagaatgaaataggaaacatatgtcagtgagatataatgagaattgggataataggttttacttagctaatattcaaaaaagttactttaaagtttctctcacacctgaactttaagttgtctgtttggaagatctgtatagagagcatcccactgttgtacagtcaagcccttcagagccaagattgcttcaatcaccagcatgtcagaaatagcatcaccagctgcctgcaaatggggaaacaaatggaagaaaccacttaacacaagcaaatcttggaaatggatgttttttcttagaaaaccaatcacagtacaggttgaacaacctgaatctgaaacatgctgagtgccaaaataatcacaagtgaaaaattccacacctggcctcctgtgacaggtcaaaatgtgggtatacaactgccaggtgtggtggcatacacctacagtcccagctactcaggagaggctgagatgggatgattacttgaagctaggagtttgaggctgcagtgtgctgtgataatgcctgtgaacagccaatgcactccagcctgggcaacatagcaagaccttgtctcttaataaaaaacaaatgcactcctgacctcactgtcaggaatttgaaaccagcctggccaacatggtaaaacgccatctatactaaaaatacaaaaattagctaggtgtggtagtgggcgcctgtaatcccatctactcgggaggctgaggcaggagaattgcttgagcccgggaggcagaggttgcagtgagccaagattgcgccactgcactccagcgtgggcaacagagcgagactccatctcaaaacaaaacaacaacaacaacaaaaaaaacccactaaaggcaggcccgcagttcattcagcatccccaagggaaaaagaccctctcagcctccttcagctatgatacatcgtttccatgcatgccagatatgtatcatattttttactattaaaatacttgtgtgtgaataagtgtaaaaaaatgattgattgcttattgattgatagcatataaattcagagttttaggaatgatggtgatgccagacaaccacagattgtccaacgggtggctgacagagtgacacctttgctttctgatggttcagtagacacaaactttgtttcatgcactaaatttacagtattctataaaaccacctttaatcttatgtaacatacatgaaacaaaagaatttagtgtttccgacttgagtgccatacccaagatgtcacattatatatatgcaaatatcccaaaatccagtgaatctggaacccaaaacacttctagtcccatgcattttggataagggatactcagcctatatcatgtgctttctcacatgcagcatgattaaatgaagtgtttttgtggatggataaaatacgaacaatgaggtgaagatctctgtggaagacaatgaaaggtataacaaagaatactgaaactagctcttgagaaacttgcctttagtactccttatttataaaatgaaattagactggataactctaaggctcagcctaacattccatcactcatttttctttttataaatagatcccttttgagatattaccccacaatgattgatagaaagcatcaaggtaaaatggagaaatatgagctttggtataagatataactgaagataaatctctgtttcttcacttataaaatggaaattacagtaacacctctccctgtgttactgtaaggattacacagcaaggtatataaagtgtccagtgtgtgcaagacactcaaataattgaatcgctttcctctaccctgagtactgcttttccatagccaaacgacactccaaccccaactaacccacatgtatgtcctttgtcaatgagacaaccagttatttgtgtttgtttttgagacagagtctcgctctgtcacccaggctggagtgcagtggcgtgatcttggctcactgcaagctctgcctcccgggttcacaccatgctcctgcctcagcctcccgagtagctgggactacaggtgcccgccaccatgcccggctaattttttgtatttttagtagagacgaggtttcaccctgttagccaggagggtctcgatctcctgacctcgtgatccgccctccttggcctcccaaagggctgggattacaggcatgagccaccgtgcctggcctgacaaccagttatttttacttaatttcatcgaggtttggttaaaaaaaaattaataatatatatgtatacactgagtagctgaatctgtgatcctaggtagaagctacccaatatacttgaaaatttccatcataagaggtaggggaagggaagcatattaaaaaatgttctgtcattccatttcattataaatctcaactgaatataccactattagaaggaagccaccaggccaggacgtctccactttaattttgtatgcacccacactctgttctgtccatcttctgaataatgtaaaggtaaccaagagtccactgccccatcagttctgacctggttaaacaagtcaataatgttttcaagcatcttagcagcttttcttttcttatcttccagttgttctgctgattgttttatcttcatttcaacagctgtactaaacagtgcctgcagcaaaagaatataaaatcagtctcaaaacactatccaaaacctagtcataagtactattattctagctaacccacttttccctcctagtcaatctggagaaactgaggggaaaaatagtggcagccttaaaatgtatgaaattaatgtaagatcacattaaaacccagaggatagtactaggggaaaaattttatttgcggattatataactggttataaaaatttaaacatctgattacaaagaaaacaccaccttgacaagaggcaagcacacacagtaagttcatgttttccctttaaccagctaaatcatttctgtgcaaccaggttacttagagcctgtctgtatcctttttactttgaaggatataattcattgcagctagtatagttttattctaaaacttaaggggatgagctaggcaaaattaagagttcatagtattcatcaaaatatggcaaataatgtcatggatagtcattacaatatataattcatcatgctcctcaagagtcttatctcatttggaaatactcatcttttttactgccttctagaggcctaatactgagcaagattagcatactatgctcaactacttgatgaaatacatttttcttgataaaataaggcacaggctagtcacctgtttttgtaaagttttactggaacacaaccacacagattcatttaagctagatcagcagagttaaacaactgtaagagaccttatggcctgaaaatccaaaaatatttactctctaccctttagaaaataatttaccaacttctccattcgatcactaaagttatatcttaattgcattttgtaggaacttatttttcccctttttatatttatgccctccaaaagccaattttaaattaatgaggaaaattatttggctttgattcaaatgttctgatagccacctcaagtgtattcattaaatgaggtgagtataaaaacattttaaaaatattctgaacattatgaatctacaaaaaactaaattatacactttaaaatgtaattttatgtaaaatgtaaattgaaacattttatgcctatcactagttaccttaaattcattttcatttcttattaattatcaactttccaacactttgcaattcaccatagcgactgaatttttcttttcctctcctatggccagccggaaaatgcatagacaacatacttataaaaaaattaagaactgtaaattttaaaaaactattcaaaacaccttagtatatctcttcacattcaaagaagaatcattaccatgtaaaagagaatcacagtttcataatacatcaatatataagataaccaaaggatctttttgtcacatccaattatttcaacaaagtacaatattacctattattacctcccagatatagaagtctcatcataaagaaaagtgccagctaaggccaactataattaagagaacttacagtgccatgcccatttgcttcaaaataaactccaatgtcaaactcttgagccttgtggtgcaaatgttttacaccagtcttagtgcaatagacaggtacctataacacatgcatttaaagaaatacagcaattactcagatgtcaaatgtttcttgcatacctagtatcccagagatacaaaggggaacaaaatactggggccgagtccagtgaggaagacgattaagcattaaaatacaaaatggtacgtatacaatggaagcatgaacacactctggaagcacgcagccaagggtaaagcacggtgagagagatgagggtctccttataagacacgaaagattacaagtgggggcgtgacatgacctaactgttttagaaagctgtttagctacagtgtggagaatagcttagagcagaattgcaagctttttctgtaacaggccagacagtaaatattttaggctttgcaggccatatggtctctgtcacaattactctgccattacagtgcaaaagcagccacagaccatacataaacaaatcaacatagctctattccaataaaactttgtttgcaaatagcagcaagttcaattagaaggttaagaaatggaatgaggaggcttctaggactaatcccagtaagaaatagtggctggatcagcaatagtgaatagggaaagtcatggatggatggatctgagagagctttaagaatggttaaggaaagattgatagtagaaaaactgcaaaagaaagatcagcattagattggatgtaggagacctcaggaatggcaagggctaaaaatatttcatctggaagacagtgagttgagaagtaacagtttcttaaactaggttattttatctgtaataaatttttaagacagaaaatgaaaatcctaaaacaataacccaagtactgtgaaataacccaatccctgtgaaaggcaggcaaatgggccccagatggaatcccttgaatgagcttattataaccatatattaaaatcaggtcataaactagcagcctcaagatatatttcgttttgcccagccactgtttctttttaaacaaataggaacatcacatgaaaattcagatttcctgcttctcttgaagagtgtgactacagttgacatcagctggcacatactgacctgtttttagccccctgctgccctcattcactttacctgtccaaatcctgcaggaatctgactttgtaattcctgctttctagagaatggaaaggtaactaaaactagtataaatgccagaacgaggtacaaaatgaggtacaaaaaagttggaaaacttctcgataatgagaaagtataggcaaacagacttccagttttgtccatgaaccctggtaactctccgagcaagtagtgtggtgccaagggtggtcacctggtggacaccggggaaataattagaaacagaatctcccaccaccccagaaaacctctccaaaaaaaaaagaagggtaagaaacagttttattactgaataagtattaagccaaactgatgttcaatcacaggctaatttgctaagagatagcaaagataaacgctcaccctttaatatagccaagcggacacattccaatacaatttgctaagataaaagatggctaatgacaaaaattctctccttgaccaaactttagttaggtttaggtgggcctgactaggccttgtccttaggcatgtcttccaatagcccgattttaataagagtcatgctaagtgagcttagcgagaatccctcatcctgatacatgaccactcttgacatctgatctgagttctcattctctaccatcccccaggtaatatgtgaccgccctggcctaccttcagcaaaagtcctgttagatcagtttagccaaaataccacccacttaccctcatgtttcctctcagtaatttttcatccactgaccaccccccacacaccctgctccttggctataaagccctacttttccttactatatttggagttgagcccaatctttctcctaccactgcaaaactccatcacattagtccctgtacctatcacaacagtcctgaatcaagtctgccttaccattttaacaagtgtcatgaattattttttctttaacactagtcctcaaataggaaaacttgaaaccaccatttgtcacacacatagtttatcctaaacttacttggtaatagggatggccacctgtgttaactgcccttctctaaaggagtaataaaacttttcatacctctgtgacaggtagatagttacaaattggacgcaaacacctaagttaaactctcctgagactgggagataggtgagctatcttccttgatgtttatatttgaaattggtgactctaggcccttaaagaaaagtattcctgagctataaaactggcttattaggcctttagaaagacttacattcattacaaaggcacagagaaagaattccaagttttctaaaggaaaactccaagaaaaggaaggaaagaagttttcctttattcatcaaggacaactaaattttttcttatttatttctctttacctttacatgaacagcagctcagcttcatgcactacaacataatcacttttatgagggcagtatctttctcacagaaacatgatcttaattaagaaactaccagaaaacaaaaatggttcaataccttcataacttcttcaagataccgtgttgaacttccatttgcatatgcagtttgtacaacaccaatattcaaactttctccaatctagacaaaaacaatgatacttaacttgccatcaaaagtatggtctacaaaaacaaatataatgagagttctaaaggctaccaaaattatcagccagttcagttgtgccttagtttatgccaaaaatgtctgactgaaaatttacatgtatgccaggaaaaaagcctaaaatacatttgaacactatttaaaacaattctatgagaattcctcttttaagaagcctgtatctcctgatcttcacctctttaattttttaaataaaagtatctggccaggcacggtggctcacgcctgtaatcccagcactctgggaggccaaggtgggtggatcacctgaggtcaaaagttcgagaccagcctggccaacatggtgaaaccccatctctactaaaagtacaaaaattagccaggtgtggtggcatgcatctgtaatcccagctacttgggaggctgaggcagaagaattgcttgagcccagggaggcagaggttgcaatgagccgagatcacgcccctgcactccagcctgggcaacagagcaacactgtctcaaaaaaaaaaaaaaaaaaaatctattaaattcttaaagtatgctgtttccagattataataatttccaattacattgtgtacttaaagctagcctgagatttatttctaaaatagcaaaatgaaacaaatctcacattactaagcttatcataatcagttaatatatcagatgatgagatttcctattagaatttagggcttttatggagtgaccacagaactgtcatcaaagtttcaattatgatggaagcaaaacttcctaaagcttcaaatcacaaaactcagccagtataaggaggaaaagagtaccttcaggttccaaagccaatgcctcaaatgttcaaatgactgggtattaccactgctctttttttaattttctgcccactaatgtaaagaatttgtcataaattgtgcccttctgacaaatgattgtaaaatatggaactatttcactactaagtcttgttttagagggtagccaatccccccaccatacctccaccaggagctctttaaggaaactgctaattaacgttgctatcttgtctccatctatgagatgaaagtggccatctgcatcatggtagtaataaacaattctgtctgcatctccatcaaaagaacagcatctttcattggacttaatttccattcctagcacacaggataatttaacatgcatttcagtctaagaatttattataaagagttttagaattttctcttaaaattatccacctaaaaatcaatgtcttaatcttaaatagtgtataatctttaaatagtacatagtttattagtggtttttacaggtcaaattctttcactgcaaagtgaaaaaaggagcattcaaaatctatgctgatatttgctataatactaccataaaattccactttataagcaggttggtttggctagacaggtgtcccataaaggttttttgaaagctacatgtatttctgaatgtaatttacctaggaccgtgatctcctttacatagaaaaaataatcagcactagatgatgtatgtgctttaattctaacagaaatgatttttatttgttcataccaccaataaaaagaaacactgataattaagagcaaagaattataactttgagagataactggcctgtgaaatttacataaagttgctgaaatctcagcaattgtcacatcaaatttattagaaaatttggctattccttagccatgacagcagcagagtgacaaattcaacatgagacaactaagaagtaaaaggcttttgtcaggaatgggatcataagattgatgaaaggacatgatgcaagcttcaggaaagcaaggactatggttttgttcatactgtagtcccaaagcctagagcatagagagtaagagctcagtatttaagaaatggataaataagtggcagaactgaactgtcaagtaaatgtcaaaacaagcaattcaatgaaaaggagctcaaattggttgactacactgacattttaaatgcttactaagtaaagcataataacatgaatgaatgaggcaactggatgaagtctgtagagttccagaatgcatgtcctattttaggggagcagcatctatctgactgtagtggactaatgccatgtgtgaacattttctgattttggtaaagagatgctagagattccaatatataagagaagtcacggaatttttaaacagtggcacacagacaaacacacaaatgcagccagccaaacaaaacatatctgcaagtcaggtttggcctaagcaaataatttagggtctataatgcagataaatccagaacacctcttactacaactaaaatctgaagaaaagtcttcctcctattctgcactgagtggaaaacactgattgctaacaactgtataagcagagttacatttgctttccatagtgtatttaattcagataaggtatctaataatacttactatgctcccctgtagatctgtgattctcaaaaagggatccccagacaagcactgggaacaaagcctgcaaacttgatagaaatgcaaatttctatcatatgcaaatcctatgccagacctccagaaactcagaagtggagcccaggaatctgtgtgctaacaagccctcaaagtgattctgacacatgccagtttgagaaccactgctctagaatgccatttcctgactttgctttccccacctgatttcctgtagactatgaggaatggtgtgatttacaggcagagagagcagaccatgtttcaatggctctgagagtgggaagacttctcaatgtctaaatgtggcagagccaggaatagctgcaagattcttaactcactttaccaccttagtttataagtgagattggcttcaaagagcattaaaaacaaatttttgcagtgctagtacgacataccctgtggaggtttctgatgacttttcacaaagtcagctccacataaatgattgagtttgcccttggacccatcattaaacagctgaactgacaggccctgtgagaagtagtgttccatttcccttagcttcagggcccctatgccatttgcacagtcaaccttaagtgatctgtattcatctccactgcaagaagcctacaaaggaaaaagacacatggaagaaaaatttcaagttataaaaataaatgtgaaatataaagcatatatacatatgtgcatatgtaaatatttagttaactcattttaatttttaaattttatcaattataattgtgttcatttttcaatttttaaaattataaaacactaaagtaaaatttaaaaacacctggaacaacagaatagttttgctgattgaacaacttatagcatagagctttattagaatttagtctcaattaacagggtctcttaaaagtaatattacaagggagccattcaaatgcaagaataagcacacagacaaatgggcagtaatgacatgtcattctttttatagtatgtgacatcatcatcaggcagatttgttttttttctaattgtctcctctcccagctatcctcaccccaaattataagttctatgagagcaagggcttttagttaattgtgcctggtaaggacatatactcaatatttgttgatcaaacgaattatacttctcaaatctctctacatttaacaagccaatatacctagaagaaaatctcaatagtacatgcctcaggtattaagccaacagcacctacattaactaagatcaaattcatctgaatgaatacttatgataccatcgtcaagacccccaccatgtttgcttccccaaagtatctcagaatgtactacataatttgccaagtaaacgccaatgtaagttagcaggatacatagaccagaaccttgtgtagccctagagaaaaacaaaaaaggagatatgcagcatctttggaaaaggaaagaggaggcatgacaaacaagataatttgttcagtagaccatgttactttattcatttgtttaactttaaccatgttcaataaacttttcacctgtttggtgagttccacaaaagccttagagagtttctggtagtaaccttctatagttgcctttccatatcggccacccgtgtttcgacaatacaccatgtagtgcagctggggtgttgttaacaagccataatctgtcatagaaatacaaaaagcaattcaccgcatttcttaacaaagagaaaaaagtttaaatgcattcatgtgtaggaatttcagggtgacaaatccttttgtgtcatctcagacatcttagaaaacataaaaatgatcttaaaaagaaatataaatgactataagaagccaaaaaaccaatcattacatataaacaggtaacaatgtaaatataaagcaatacagacaagtaataattgagttctgtttccagtaacattgcaaactacataattcagatgaatcatcctcctggaaacaaccaacatgctagataaaagacaaaaacctccttttaaaaagaactacagtgctgaaaagtgacagaattatcaggccaaaacatacccgaaggcaagaactccaagatctaagctagttcggaagccagttttgttctgaagttattcctctaaactagaaattgagctacggttttcagagcaaaaaaagcccatgctgatctaagatgcagaacccagtagaagaccagactctcatgaagttgaaatcccaaagaactatatcttcagtccgaggatgagtcagaaattaatcaccccatgtcaccattcccaggacagttatcttaacactgagcagggaagacgggaaaacccattcttgaagagctgttaccaagcacaggcccttgcatggacttcctgcccaacatacataaccacaggagtccaaaggaactttgtcatgaattttttttttttgagacggagtttcaccgtatcgctcaggctggagtgcaatggcgcaatctcagctcactacaacctccacctcccagcctcaagtgattctcctgccaagtagctgagattacaggcacccaccaccacgcccggctaatttttgtatttttagtagagacagggtttcatcatgttggccagactggtctcaaactcctgacctcaaatgatccacccacctcatactcccaaaatgctgggattacaggcatgagccaccacacccggcctgtcatgaatcaatttaaagtgaacccagccagtgccccaggtacccagcagaagccagactaaactttaccaaaggactatactttcattgtaaacctcaaaaacgtcccataattttcaaaaacaaaaagaaagaaaaccagcttacagttaaacatagctaacatataagaaaagcaccatgagcaaaaaacaaagaaaaatggatcgcaaagatggaccagtaaccaataagtaaatactcagtgactacacctgtcagttggacctgaacctcaaacacaagaatttgactgcaggcaaaaaggagtcactttaaattcttgagccctgaagttatttaacagaaatggtaccttatgaaggcaaccttagctctggtataatgatgagatgggaggagatggagaagctcaaaaaatacaaataagagcttagattagtttaatggaagtgtttactagaggaacccattattctaaaagacatgctaaagtaagaaacaaaataattttgtgaccaatatcaaaattaccaaataaacatttactaaatgactagtatatatacccagtgaaaagcattatctatccaactcatcaactcagaaacctggaatgtgttcttcacagttctgttctccccatatatcacaaaatcctttgaatgcaataccaatttttcaagagcggcctagctggtctgtttccctttcttaacaactttcctttcccttctctctgtgacaaacagagggactggcttaaatgaaaatgtgatcatatcactctcttgcataaaatccttcaatggagtcccattgcatctggaatagagcccaagttcttgccatgacctccaagatttgtatgaattagtcccaccttacctccctactctcttctcctagcccctcttctccctatgttgcagctacattaaccttttttcatttactgaaatacactaagctgaagagagaaatgaaggaaaggttaaaaaaattactctcaactttttctagactaaaacactagaagagtgatggttctagcgacagaatgaaaatgctgaaaaagacaaccattctggggatgacagaaagaatacagtttggggcagggtgaacatgagacagaagcaggccacctaagggaagacaccactcagaccaatgctttacaaactgcaggccacagcctgccaatgggccatggaatttacttagtgagacacaaccagcatttgtgcattttaaacagatgactgcatgtcatgtaggctggatgagcattgtttattgaaactattatttcagttatacacacaagcacacattgacatgtcatgacacataatgggtttcttactatgggttgtgatacacagtgaaacagaaatagactactagagggatgtacacagcaggtagtaaaacatgtttgatgaattaacaaatgaatgaggccgggcgcagtggctcatgcctgtaatcccagcactttgggaggccgaggcaggcggatcacgaggtcaggagattgagaccagtctggccaacatgatgaaacgccatctctactaatacaaaaattatccaggtgtggtggcatgtgcctgtaatcccagctactcgggaggctgaggcaggagaatcgcttgaaccagggagtcagaagttgcagtgagccaagatcgagcctctgcactccagcctggcgacaaagtgagactccatctcaaacaataaataaataaataagtaaataaataaataaataaatgaaaaaaggtagctcaagctatggcagtagagataatcattcagaaatcatgcagaatgaaagagggtcccgaggaatgccctccctgaaagagacagaagaggagccaacagagaagaccaatatggaatagtggccaagcaagtagaagctcaaagaaagagctttaacattatggaaagctacaaagacttcaactgtaagatctttaaagcataaattattaaaattatttttagatcacagccccctctgagtatctgaggagaggtacgcatgcactccctgggaaagtgcttgtgccggcaacactctgtacatcgtatcatgaggtccacaggtcctctgcagctttcccagacatgccacagaggtccctggttaataatccctactttacaatacccaccagatttggcaataacaatgcagatggatgtcaggggtgggctggggagacatttatttcaaggagaggtaaggatacagactcacctgcagaaagctgaagaatgacagaagaggaggaaacagagaaggtaagcagagctagccctcagcagaggccagactgaccgtgcaggaagggaacacagtcggaactcgagaggaggtttcaaaggtcaagagtggacgtttgttttaatgagaaagatctcacaccaggaaaatattcacctcaaaacatggtggaggcagtgccttcacaacagacacagtgtgagaaggggatcctagtctgttttgtttcacttaattctctgtcatttgatataacataaagaactacctgtcaaaaatatttcccatcactacttgacaggtaacagctgatttcacagggaaccagctattagggaagacctaataatattgataaaagctccccagaatgatcatcttcaagtacttaaaaaggtttttatttgaggaaattcagccttaccaaagtaaaggaagttgtattagttcagaatttcccagctataatctcctatagtactaccataggtaagacaaaacatgcctgcccagaaacgacctggaagatgatttttaaagttagtattttgtatctaggagttcattttttaaacattttttgttcatctgtattttcaaacttttctaaataaatatacattacttttgtaaattaaagttttttaaatattagtttaatttccaactcaggataactacataccatggaattgacctcctagaacagtcacaccatctattacagattgtgaaagtttctcactgctgggcctaggaaagaaaaggaagaaaataatatatcccatcctgaaactggcagggttgctggttctgcaagcaaatgcaaaaattacatgctacaaatttcaaaatagtaagttcctggtatctgaactgaaagctatgaactctcaagataactggtaaattataagcattttccagtagcctttcacaatctagttctaggaaaaattctggcttttaaatgaatttataaaatagatataaaggacactctaaccacagcatacccaaataccttttcaagttcgactacagcaacatgtctgaactctaagaacagtaacaataaacactgaatatacacagtgtgtataagacagtacttgtattaagctgccaaggatatagaacctgttttccattttgtaaagtcagaacaaattatctatctgaaaataaaacagattacaaaactgccttggccaggcacagtggctcacacctgtaatcccagcactttgggaggccgaggtgggtggatcacaagattgagaccatcctggccaacacggtgaaaccacgtctctactaaaaatacaaaaattagctgggcgtggtggcacacagctgtagtcccagctactcgggaggctgaggcaggagaatcacttgaccctgggagtcagagggtgcaatgagccaagactgtgccactgcactccagcctggtgacagagcgagactccgtatcaaaaaaataaaaaataataaaaaaactgccttgtaggaaaaaacgtttcatcacttacattagttaatagttaagaaccaaatacatgtgggatgactttactgtggtgggataatttacttcagaacataagttactctgctaccatcgtcggtatctggaaaaccctctggtaatacaacagagggtaaaaaaaccagtccaggtattggagattgagtagaaatttccttttgaaataatctcaggttaaaaccagatcttatgcaaaaggaaatgctactgttgcaaagtatacttttcatctaatattttacaaaaagacatttttgttaagaaaggcaaaagctgcaaaacagaactatgtggaaaataatattgtagtttacagtgagctccagcatgggaaaatgatataaatatttgaaacaataataacacagattacaaagtaaatctttaaaaataatgagttcaaatcatgtgttgactctgtagggaaaaaaaaataaacctacagagggggtgggagacatttattgagtgcttctcttgtgtcaggaagtattttacatacattattctgcagcttgggttttggagtagggttttaaaccagagtcagactccaaaccccaagctgcagtagtgacttagctactacatcctactagaaaggccaggcaggtagacatgcaactcagggtagttccactttacttctttccatttgtcttggattaaaactgatacaatcgtttatatcacgttcccaaaggtttttttttttaccagtaactcttatcatcacctggtatctctaccaataactacaaaggcatcttgttgcagattcacagcttctttctcgctgatgtcaataagcactctctgcatatcttgttcctcagcatttgctaaacaggtggcatgttcctcccaggatggtgccaacatttcacccaaaggatcaaccaattttacaccattgtcttccttaaaagaaaaacaaacaataagcaatctgtgcatactcatgaggctgagttgagaacagaactcaaaagctgtttcccttcaaccaaagacagtgatggctgagcagcttcaacaataaacaccaaatattaatactggaccctggattaggtattttatgtatatatattacctcattaaatcctcatgacacacataatcaattaaactaataatcctattttaatttcaatcttcgagaaaactgagcttcagagaggttaggtaatttgcttatgatcatacagctaacaaatgtcagtactgatattaaaacagcaagtctatcttactcgcctaaaaacactatgccacactagcctttgtaaaaggctgtgatctgtgcatccactatccataaactgactagggcacaagtggagcagaataagggcacacagagatccttctcactatgactcggaactccaagaacacactagccagcttgtcaaccagcgggtaggacagacactgaaaactgcctcccaacactgttctgctcaaattcgtggaaagaaagtgtagttcacagtgaatgtcacctgaaagaaaagagaatcattttgagaagtgcctctggaactagcaataaatgtgagggtcttcctagaagtcaatcagtcaatcaattatggtgacttacatatttagacatatacacatttataatgatcacatatttggacaagcaatgcccttgtttgggggaagaggaggttacaatccttcacagacctacaccactttaacttgctgctgatttagctacaaaggcaaaaatcccacagccccagcaatcaaatagaagcatattattcaaaccctgtattaatggcctatagctaataaagaataactacattgtgtcaagaggttggctaagatatagaaacaacaaaagtgctcataaacagataaatggatgaagaaaatgtggtatatatacacaatagaatattattcagccttaaaaaagaaatactgccatttgcatcatggttgaatctggaagacattatgcgaagttaaataagccagacacatgaagacaaatactgcaggctcataacatacatgtgttatgtaaaaaagtgaaactcacagaaacacagagtagtatggtggcggctagagggtaagggaaatggggagatgctggccaatgggcataaacttgcagttataagatgaataagttctggaagactaacgtacagcgtggtgactatagttcataataatatatattgaaaatgtgttgagcgtacgtcttaagtattcccaccacaaaacaaggtaactatgtgagctaatggatatgttaattagcctgatagtggtaatcatttcacaatgtatacatatatcaaaacatggtgttgtatgacttgaattatacaatttttatttatcacttatacctcaataaagctgaaaaaataattgtgtcaaaaagaatactttgattaaaatctaactgtcacaaagactagaactatcaggcgtcatcaatattctgccaaagctcacctgtttgttcattcagaacaagaaattattgccgagctataaaaacctgtctgaaaatgttcaaaatgtttcttttcaaatctttacccttccccacccaaccccaatatctttaatcactgctaagttaacaaaggaaacaattttcaattactgaaaatgtcttaaatcaataaatttggaaggacattgttatttctctaatatggacactccaaaaaatgacagtatcttttcattctttccacacccttaggaatcatgagcttaatgatcatgctcttaaaaaaaaaaagttgtttcacatccaaagcacatataaatgagaaggcacattcctagaattagaatttgtactttaggtcaatttgctcagacactaaggcttggtcttgtaaataatggtctgctttatcagggcactaaacccattacctcaggattgtgggacgctgttaccatgactcctatagtggattttgtctgttttgacctcaggacagctaataatcccatgcgaaacatgacatgatcaagatgttctgccttcgttcgaaatccagcagtcccgtattgaaggatcagtccattgggcttggcgtgtaatgctgagtattttgtaatagcacctaaatccatgtctacaaaattaagaaatattgtttcgggcataacaagtaatttcttaagaaccatttgcttcaaaaactgccaccccaaacgaataggtctgtctcatcctgaacctcctcaaagaaccctatgtttgacagagcaatgggcaggagagtaagtcctgtgggttagaattacctacaagatgttgtccaacttggtatgtccactcctgggcagactcagggcagatagcagattgtccccactctcctcccattttagctccaggactatcctggacgccgggcacacttaaattggtccactctcaactaaaatgaagattttacacctattcagagactccaatgagctcaaagatcatttcattttacaaaaagggaaactaacctaaattaacatagatagctggtgacggattgaggcctaaagtcagattcttgagtggactgaaactacatatccccaaatatctgagaaatctttgtggttcttttgctatttctcccaaactacagagacatattcttaaaggaaaagcaaaaggcaacagtttcttctccaagactacccagatctttttccatttgctaaaaacaatcaggacacccttctaagatgttgctctaaaactagcaatatcttcttctgaaagaatgccacctttttcctttacttttaaaaataaaacatcggccgggagcggtggctcacgccagtaatcttagcactttgagaggccaaggcaggcggatcacctgaggtcaggagtttgaaaccagcctggccaacatggcgaaaccgcctctctattaaaaatacaaaaaaattagtcgggcgtgttagctggcgcctgtaatcccagctactcgggaggcagaggttgcagtgagccgagatcgcgccactgcactccagcctgggtgacaaagggagactcggtctcaaaaaaaaaaaaaaaaaaaaaaaacaggccaggtgaggtggctcaggcctgtaatcccggcattttgggaggccaaggcgggcggatcacgaggtcaggaattcaagaccagcctgaccaacatggtgagacccttgtctctactaaaaatacaaaaagtagcctggcgtggtggtgcgcgcctgtagtcccagctactcaggaggctgacgcaggagaatcgcttgaacccgcgggtggaggtcgcagtgagccgagatcgcgccactgcactccaggctgggcgacagggtgagactccgtctcaaaacaaacaacaacaaaaaatcggcccttagcccactaatactgttttctctgggatactcccattaagtggaacttggggtttccaacctcagtcagtagttttccttcagtagtccatatactacatttcctgggtcaattaattcccaattagcccagagatgaggagcagtccgccagctgctagcctcataattttgttttctttattgtccttcattgcttcaatgaacagaacttgcaagaaatggtgaaaaatacttgcttttgtccagttggaaaaagctggcattcagtaaactaatttagttcaagacagtgatcagatctctttcctaaggatgaatacatatttgtaaaaactgagcagtcagttatgtgtcatgattattcataagagtgtaaaccagtcctgttaactccaaaaagccattaaaaaaaaaaaggtccagataatatgagttcatcctttcatgcgttttaggccctacaactactttcaatgcctctgcgaatgcctttattgaaagcatatttgccaaatccagcgtccacgcaaaaagttaagagtatccccctactctccattcaatcttcaaatctccttggtgcctctctcccgcctaccctcgaatcaccgcacaagggtgattcccggcactccaccctgaggtccccgcctaggtccacgtaccagagccccggcaggagacccgcggcccgtcccgaccagcccgcccgcggggcgcaggggcctgtaggtgtgtcccgcgcgctccgccgctcggtcagtcgcccgccagaccactagcccctccgtcgggccgagaatctgacctgtcccgctcccaccgagcccttgccgaccggtagtctcccttctcaactccgagcctcggggcccggcttacctcggtcaggaagcccccttcacctacacgcagcggagaagcgcccaagcaacaacgtctgcacccaaacccagtcctcagaaccgcagacgtggccctgcgtggcttccggctcgtcgccacgccccctggccaatcacggcagaggactatccgccagccccgcccccgcctcgccgcaggtcgcgcgcagctggcgcctgaggaactgcggctgcggttccgagcggggtctggggctgttaccattgagtgaccagaaagggtgaggcccccgcggtggcccgggggttggggccgagggtcgcgggccctcagagcactgcggccgcggaggcacagcctccgcctccaaatccgggcctctgggggcggcaggccctgcgttcctgggaagccggggttcctagtggtcttggctaggggcgggggtggggaatcagccccgtcgctgggcctcggacagggcgacctcgcccacagtgagcgccgccggcggcccgcatccccctctccgacgtcgaggtcatctcccaaacctttgaatctgggaagccttctccggctgccgtctccccgggtacccccttcccccagctcactgtaaacatcttttatttaatgacctctgagacaccccctacccttatcctgggtccctcggggcagaggccagtgaatcgtaaacgtccggagccctggaatgcggcccaagcgaaaaggccaccgcggtgttgggggggggcggtccgcgagtc

SEQ ID NO: 1902 - DNA, 28420 bp, Homo sapiens
ttgtatggaaacatttgactttatttaatattgagacaatacatatagttctgattaagagcatcagaaactctgaatcaagtgtattcttcttggtcaagagcttaataaaagtccctctcttaaaggctcatcttgataggaatagaaacaaaaggttaccccatagttctcttacatttggaagttagctatatagagggtacaaggatattcattttccttcaggacaaagtcatctctgtacgccctttattgttgaattgcagtttgatttaggggattagaggtggtatggtaccagtaattgagtaatggtggaaatgtgaaagtcagtcacaggactctcattggtgccagtgtcatagttaagaaagaaagaaagaaagttttatatatcctgtaatctagactggaagctaaataattgctaggaagcaaacttaagtgatagctgttaagttttttggtttgtttttgaccagagatgatgaagtaggtgatcttttcttggtttgctcctagactcttccattttaacttatatttttagtttggtgcaaaagtaattgctgtttgggaccatgaattttaagtcattataactaggttcacacaaatctttattaattaaaataggaaccattacaatcaacacatttttgccaatgagaaataagtttgtttactcctgtagcataaaaatccatgcttccaaatttgacgaactcttggaaagcattttctgtgtcctgctagttgtggaagcaatttccctgcaaaacgttgctgagatgcctaaagaagtggtagtttgttggcaagaggtcaggtgaatatggcagatgaggcaaaacttcatagcccaattagttcaattttcgaagcgttggttgtgcaacgtgcggcccagtgttgtcgtgaaaagaattgggccctttctggtggccaatgccggctgcaggcattgcagtttttggtgcatctcattgatttgctgagcatacttatcagatgtaatggtttcacctggattcagaaagctgtagtggatcagactggcagcaaaccaccaaacaatgaccatgaccattttttggagcaagtttggctttgggaagtgctttggagcttctttcagtccagccactgagctggtcatcgccagttgtcgtataaaatccaccttttggcacacatcacaatccgatagagaaatgattcattattgttgcatagaatagagaaaatgacacttcaaaacaacgaatttttttatttttcactcagctcatgaggcacccatttattgagctttttcaccttttcaatttgcttcaaatgccgaacgaccataaaatggtcaacattgagttcttgggcagctctcttatagttgtaagaggatcagcttcgatgatgttctcaattggtcattatcaatttccgatgactggccactgcactcctcatcttcaaggctctagtctcctttgcaaaacttcttgagccatcacggcactgtatgttcattagcagttcctgggccaaatgcattgttgatgttgtgtgttgtctctgctgctttataacctattttgaactcagaaaatcgctaaatttgatttttgtctaacatcatttccatagtctaaaataaatataaacagcaataagtcattagcaaaaaaaaagtgagaaatatgcttaaaatgatgtataacataaccacatttatttaagaatgtactccaatataaaacggcaaatttcaacaatgcaaaaaccgcaattacgtttgcaccaacctaatattttcctttttcaggattttactttaaaataagcaataagcttgagagcacatagaagaaaataagctggattttgcatctgcttgacccactaggaaactagtgatattaaattattaggtaaacaatgaaagtttctgagcaacatctgatcttagaaggcaaactccatttgttaatatgacagattgtaattctgcttcctaagtcttcatgatttcttccttctgtctagttcattgcttattttcattctttagtgtggaattgtatctgtgattctgcccaagttcaaccaacctgttctctcttatctttctctagacagaatgatgtctgtagctgtgtttgtgtaattcaggtggcttctcaaactagcctcttaatacccaaattattagtctttatatttagttgacagagttttcacataccttctcatttgacttctctactaaaaggtagttttagactgtcccattttataagtgaggaacctttgtatatcctgcccaagggtgccgtaagtatggcagagccagcacactaactcaattcctttgactccaggtccagctttcctccctatgttgtttagcacaacccagaaggagacagcagtgtctcctgagggatcccttcctttctctgtgatgcagtactgacagtaattattcactttggacactgctaccatcatggcaaatttaggccatttagataaaagggaattaactaattataataaaaggggatatattatgaaatgtataaagcactttgttccttttttctgtagtaattttgtgacctagtccttggttacagtagtgagggttcagaaacctgggagctttttgagtaaatacaaagcacaacataaaacttttatgtttgactctattcctgttcaaagctatttctgttaactaagcttatctgcgcattctagttgggaactattactacaatgttagactgctccatgtaaaactaataaatggcagtaaaaggtctcagaagcaccaagggttttgatcaggtcaggagttagaaacttaatgtcatttgtattcatttcttgaccaattgccaaagtttatatatttttaatttttctaacataccacattgtctgttgtattaataccagttcactttttgttttctgcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatataggtaagtcatctaataatctttcttaagactctgcaatggaaaaactggttgtataaagtcttctctgccctctccatttgtatcagcaatggggaatgctgcaaaacatcatcttgctcatgtgatggtgatggcaaagatatcacaaggagttggtaataagatttaattttccagtagcctgcatgaattgttccccacataaaactgtacagttagtgactgaattgtatacttaagtcccagtattttacattagtgagactgaaattagaggtaaatttctttaacaagtgtaaggcttacctatttataaagaattattctgttagtgtttaagaaaaacagatctagagacaatccagtaggctgcattgtaaacattatgattataaatctcttagtactgccattattattgacagttttgtaaagacttgtaaaaagtccagtttctcaggaatatgaaaattatcttcagaaacctggttggggcctttctccaattcctccagccagctgaaatactgccaagctcacttcatgtgcaaggtgatctgcactttcctgcaaattacattaaaagagattagatgagaaagacatagcatgtgtctaacatgggcaagaccatgttacttggaactctggggaagagaggggtgattcttgattttgtttcactaacaaattctaatgaaaaccttttttcatctttcagtaacaaattccaaagcccttaaataaacggaaaacagaccaaattcttctaaataaggtaagtttttaatcaattcagattataaaaatagctatcattccacaactgaaaaaattcaataaaactttaatccacaattggcctaacagtaagtaagtactaatgcctctgttgccatctcctcatccatcatggatattcattagactctgagatggcttaagcttctgcaggaaagctgccaaatgtctcctcctgattccctattcagcgcactcactgtactttgccctggctttgcacacactttaaggagtatgtgaagaggccaaataataaaaatccagaccacaagtcttgacccctgtcagggaaacaggcacagagtaaggctgtcatttaaaggaaatattttgaaaaacaaatcaagagtccagaatgctatcagttgacttagaaatgaactacaaagctggttgttttcatgtcacaagagtatatttttaaaagaagagaaaaggatcatctaccttatagtgcataaactaagtatttattagttattcctgccatggttaaaaatatgacactttcaggaagtctagaataagtcaaaaatatttggggaaataaactaagtgggtctaattttgttaaattgtataattactgctggtgaaaataattttgtagtcttaatgtgaacctaaaaggctcaacaaaataaagccttaatcatcatagtgagattctaaaaaccattaaaatagtttgcctgcccatcacctaatattaggctctttttcaatagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgatgcgtcattcatattatttattatatcataaagttggaaaccaaatacttcacagacaatagaatgttaagtaaatgaacttagttattctataatttttttttcagctgtaagagaatacaattaggtatcataaggccttctttttttgttttgagacggagtctcgctctgtcgccaggccagagtgcaatggcataatctcggctcactgcaacctctgcctcccaggttcaagtgattctcctgcctcagcctcccaagtagctgggactacaggtgtgtgccaccacgcccagctaatttttgtatttttagtagacagggttttaccatgttggccaggctggtctcaatcccttgacctcatgatccgcccgctttggcctcccaaagtgctgggattaaaggcatgagccacgagctactgcgcttggcccataaggccttattttctatgtatcatatgtgtatgtacagaatgaaataggaaacatatgtcagtgagatataatgagaattgggataataggttttacttagctaatattcaaaaaagttactttaaagtttctctcacacctgaactttaagttgtctgtttggaagatctgtatagagagcatcccactgttgtacagtcaagcccttcagagccaagattgcttcaatcaccagcatgtcagaaatagcatcaccagctgcctgcaaatggggaaacaaatggaagaaaccacttaacacaagcaaatcttggaaatggatgttttttcttagaaaaccaatcacagtacaggttgaacaacctgaatctgaaacatgctgagtgccaaaataatcacaagtgaaaaattccacacctggcctcctgtgacaggtcaaaatgtgggtatacaactgccaggtgtggtggcatacacctacagtcccagctactcaggagaggctgagatgggatgattacttgaagctaggagtttgaggctgcagtgtgctgtgataatgcctgtgaacagccaatgcactccagcctgggcaacatagcaagaccttgtctcttaataaaaaacaaatgcactcctgacctcactgtcaggaatttgaaaccagcctggccaacatggtaaaacgccatctatactaaaaatacaaaaattagctaggtgtggtagtgggcgcctgtaatcccatctactcgggaggctgaggcaggagaattgcttgagcccgggaggcagaggttgcagtgagccaagattgcgccactgcactccagcgtgggcaacagagcgagactccatctcaaaacaaaacaacaacaacaacaaaaaaaacccactaaaggcaggcccgcagttcattcagcatccccaagggaaaaagaccctctcagcctccttcagctatgatacatcgtttccatgcatgccagatatgtatcatattttttactattaaaatacttgtgtgtgaataagtgtaaaaaaatgattgattgcttattgattgatagcatataaattcagagttttaggaatgatggtgatgccagacaaccacagattgtccaacgggtggctgacagagtgacacctttgctttctgatggttcagtagacacaaactttgtttcatgcactaaatttacagtattctataaaaccacctttaatcttatgtaacatacatgaaacaaaagaatttagtgtttccgacttgagtgccatacccaagatgtcacattatatatatgcaaatatcccaaaatccagtgaatctggaacccaaaacacttctagtcccatgcattttggataagggatactcagcctatatcatgtgctttctcacatgcagcatgattaaatgaagtgtttttgtggatggataaaatacgaacaatgaggtgaagatctctgtggaagacaatgaaaggtataacaaagaatactgaaactagctcttgagaaacttgcctttagtactccttatttataaaatgaaattagactggataactctaaggctcagcctaacattccatcactcatttttctttttataaatagatcccttttgagatattaccccacaatgattgatagaaagcatcaaggtaaaatggagaaatatgagctttggtataagatataactgaagataaatctctgtttcttcacttataaaatggaaattacagtaacacctctccctgtgttactgtaaggattacacagcaaggtatataaagtgtccagtgtgtgcaagacactcaaataattgaatcgctttcctctaccctgagtactgcttttccatagccaaacgacactccaaccccaactaacccacatgtatgtcctttgtcaatgagacaaccagttatttgtgtttgtttttgagacagagtctcgctctgtcacccaggctggagtgcagtggcgtgatcttggctcactgcaagctctgcctcccgggttcacaccatgctcctgcctcagcctcccgagtagctgggactacaggtgcccgccaccatgcccggctaattttttgtatttttagtagagacgaggtttcaccctgttagccaggagggtctcgatctcctgacctcgtgatccgccctccttggcctcccaaagggctgggattacaggcatgagccaccgtgcctggcctgacaaccagttatttttacttaatttcatcgaggtttggttaaaaaaaaattaataatatatatgtatacactgagtagctgaatctgtgatcctaggtagaagctacccaatatacttgaaaatttccatcataagaggtaggggaagggaagcatattaaaaaatgttctgtcattccatttcattataaatctcaactgaatataccactattagaaggaagccaccaggccaggacgtctccactttaattttgtatgcacccacactctgttctgtccatcttctgaataatgtaaaggtaaccaagagtccactgccccatcagttctgacctggttaaacaagtcaataatgttttcaagcatcttagcagcttttcttttcttatcttccagttgttctgctgattgttttatcttcatttcaacagctgtactaaacagtgcctgcagcaaaagaatataaaatcagtctcaaaacactatccaaaacctagtcataagtactattattctagctaacccacttttccctcctagtcaatctggagaaactgaggggaaaaatagtggcagccttaaaatgtatgaaattaatgtaagatcacattaaaacccagaggatagtactaggggaaaaattttatttgcggattatataactggttataaaaatttaaacatctgattacaaagaaaacaccaccttgacaagaggcaagcacacacagtaagttcatgttttccctttaaccagctaaatcatttctgtgcaaccaggttacttagagcctgtctgtatcctttttactttgaaggatataattcattgcagctagtatagttttattctaaaacttaaggggatgagctaggcaaaattaagagttcatagtattcatcaaaatatggcaaataatgtcatggatagtcattacaatatataattcatcatgctcctcaagagtcttatctcatttggaaatactcatcttttttactgccttctagaggcctaatactgagcaagattagcatactatgctcaactacttgatgaaatacatttttcttgataaaataaggcacaggctagtcacctgtttttgtaaagttttactggaacacaaccacacagattcatttaagctagatcagcagagttaaacaactgtaagagaccttatggcctgaaaatccaaaaatatttactctctaccctttagaaaataatttaccaacttctccattcgatcactaaagttatatcttaattgcattttgtaggaacttatttttcccctttttatatttatgccctccaaaagccaattttaaattaatgaggaaaattatttggctttgattcaaatgttctgatagccacctcaagtgtattcattaaatgaggtgagtataaaaacattttaaaaatattctgaacattatgaatctacaaaaaactaaattatacactttaaaatgtaattttatgtaaaatgtaaattgaaacattttatgcctatcactagttaccttaaattcattttcatttcttattaattatcaactttccaacactttgcaattcaccatagcgactgaatttttcttttcctctcctatggccagccggaaaatgcatagacaacatacttataaaaaaattaagaactgtaaattttaaaaaactattcaaaacaccttagtatatctcttcacattcaaagaagaatcattaccatgtaaaagagaatcacagtttcataatacatcaatatataagataaccaaaggatctttttgtcacatccaattatttcaacaaagtacaatattacctattattacctcccagatatagaagtctcatcataaagaaaagtgccagctaaggccaactataattaagagaacttacagtgccatgcccatttgcttcaaaataaactccaatgtcaaactcttgagccttgtggtgcaaatgttttacaccagtcttagtgcaatagacaggtacctataacacatgcatttaaagaaatacagcaattactcagatgtcaaatgtttcttgcatacctagtatcccagagatacaaaggggaacaaaatactggggccgagtccagtgaggaagacgattaagcattaaaatacaaaatggtacgtatacaatggaagcatgaacacactctggaagcacgcagccaagggtaaagcacggtgagagagatgagggtctccttataagacacgaaagattacaagtgggggcgtgacatgacctaactgttttagaaagctgtttagctacagtgtggagaatagcttagagcagaattgcaagctttttctgtaacaggccagacagtaaatattttaggctttgcaggccatatggtctctgtcacaattactctgccattacagtgcaaaagcagccacagaccatacataaacaaatcaacatagctctattccaataaaactttgtttgcaaatagcagcaagttcaattagaaggttaagaaatggaatgaggaggcttctaggactaatcccagtaagaaatagtggctggatcagcaatagtgaatagggaaagtcatggatggatggatctgagagagctttaagaatggttaaggaaagattgatagtagaaaaactgcaaaagaaagatcagcattagattggatgtaggagacctcaggaatggcaagggctaaaaatatttcatctggaagacagtgagttgagaagtaacagtttcttaaactaggttattttatctgtaataaatttttaagacagaaaatgaaaatcctaaaacaataacccaagtactgtgaaataacccaatccctgtgaaaggcaggcaaatgggccccagatggaatcccttgaatgagcttattataaccatatattaaaatcaggtcataaactagcagcctcaagatatatttcgttttgcccagccactgtttctttttaaacaaataggaacatcacatgaaaattcagatttcctgcttctcttgaagagtgtgactacagttgacatcagctggcacatactgacctgtttttagccccctgctgccctcattcactttacctgtccaaatcctgcaggaatctgactttgtaattcctgctttctagagaatggaaaggtaactaaaactagtataaatgccagaacgaggtacaaaatgaggtacaaaaaagttggaaaacttctcgataatgagaaagtataggcaaacagacttccagttttgtccatgaaccctggtaactctccgagcaagtagtgtggtgccaagggtggtcacctggtggacaccggggaaataattagaaacagaatctcccaccaccccagaaaacctctccaaaaaaaaaagaagggtaagaaacagttttattactgaataagtattaagccaaactgatgttcaatcacaggctaatttgctaagagatagcaaagataaacgctcaccctttaatatagccaagcggacacattccaatacaatttgctaagataaaagatggctaatgacaaaaattctctccttgaccaaactttagttaggtttaggtgggcctgactaggccttgtccttaggcatgtcttccaatagcccgattttaataagagtcatgctaagtgagcttagcgagaatccctcatcctgatacatgaccactcttgacatctgatctgagttctcattctctaccatcccccaggtaatatgtgaccgccctggcctaccttcagcaaaagtcctgttagatcagtttagccaaaataccacccacttaccctcatgtttcctctcagtaatttttcatccactgaccaccccccacacaccctgctccttggctataaagccctacttttccttactatatttggagttgagcccaatctttctcctaccactgcaaaactccatcacattagtccctgtacctatcacaacagtcctgaatcaagtctgccttaccattttaacaagtgtcatgaattattttttctttaacactagtcctcaaataggaaaacttgaaaccaccatttgtcacacacatagtttatcctaaacttacttggtaatagggatggccacctgtgttaactgcccttctctaaaggagtaataaaacttttcatacctctgtgacaggtagatagttacaaattggacgcaaacacctaagttaaactctcctgagactgggagataggtgagctatcttccttgatgtttatatttgaaattggtgactctaggcccttaaagaaaagtattcctgagctataaaactggcttattaggcctttagaaagacttacattcattacaaaggcacagagaaagaattccaagttttctaaaggaaaactccaagaaaaggaaggaaagaagttttcctttattcatcaaggacaactaaattttttcttatttatttctctttacctttacatgaacagcagctcagcttcatgcactacaacataatcacttttatgagggcagtatctttctcacagaaacatgatcttaattaagaaactaccagaaaacaaaaatggttcaataccttcataacttcttcaagataccgtgttgaacttccatttgcatatgcagtttgtacaacaccaatattcaaactttctccaatctagacaaaaacaatgatacttaacttgccatcaaaagtatggtctacaaaaacaaatataatgagagttctaaaggctaccaaaattatcagccagttcagttgtgccttagtttatgccaaaaatgtctgactgaaaatttacatgtatgccaggaaaaaagcctaaaatacatttgaacactatttaaaacaattctatgagaattcctcttttaagaagcctgtatctcctgatcttcacctctttaattttttaaataaaagtatctggccaggcacggtggctcacgcctgtaatcccagcactctgggaggccaaggtgggtggatcacctgaggtcaaaagttcgagaccagcctggccaacatggtgaaaccccatctctactaaaagtacaaaaattagccaggtgtggtggcatgcatctgtaatcccagctacttgggaggctgaggcagaagaattgcttgagcccagggaggcagaggttgcaatgagccgagatcacgcccctgcactccagcctgggcaacagagcaacactgtctcaaaaaaaaaaaaaaaaaaaatctattaaattcttaaagtatgctgtttccagattataataatttccaattacattgtgtacttaaagctagcctgagatttatttctaaaatagcaaaatgaaacaaatctcacattactaagcttatcataatcagttaatatatcagatgatgagatttcctattagaatttagggcttttatggagtgaccacagaactgtcatcaaagtttcaattatgatggaagcaaaacttcctaaagcttcaaatcacaaaactcagccagtataaggaggaaaagagtaccttcaggttccaaagccaatgcctcaaatgttcaaatgactgggtattaccactgctctttttttaattttctgcccactaatgtaaagaatttgtcataaattgtgcccttctgacaaatgattgtaaaatatggaactatttcactactaagtcttgttttagagggtagccaatccccccaccatacctccaccaggagctctttaaggaaactgctaattaacgttgctatcttgtctccatctatgagatgaaagtggccatctgcatcatggtagtaataaacaattctgtctgcatctccatcaaaagaacagcatctttcattggacttaatttccattcctagcacacaggataatttaacatgcatttcagtctaagaatttattataaagagttttagaattttctcttaaaattatccacctaaaaatcaatgtcttaatcttaaatagtgtataatctttaaatagtacatagtttattagtggtttttacaggtcaaattctttcactgcaaagtgaaaaaaggagcattcaaaatctatgctgatatttgctataatactaccataaaattccactttataagcaggttggtttggctagacaggtgtcccataaaggttttttgaaagctacatgtatttctgaatgtaatttacctaggaccgtgatctcctttacatagaaaaaataatcagcactagatgatgtatgtgctttaattctaacagaaatgatttttatttgttcataccaccaataaaaagaaacactgataattaagagcaaagaattataactttgagagataactggcctgtgaaatttacataaagttgctgaaatctcagcaattgtcacatcaaatttattagaaaatttggctattccttagccatgacagcagcagagtgacaaattcaacatgagacaactaagaagtaaaaggcttttgtcaggaatgggatcataagattgatgaaaggacatgatgcaagcttcaggaaagcaaggactatggttttgttcatactgtagtcccaaagcctagagcatagagagtaagagctcagtatttaagaaatggataaataagtggcagaactgaactgtcaagtaaatgtcaaaacaagcaattcaatgaaaaggagctcaaattggttgactacactgacattttaaatgcttactaagtaaagcataataacatgaatgaatgaggcaactggatgaagtctgtagagttccagaatgcatgtcctattttaggggagcagcatctatctgactgtagtggactaatgccatgtgtgaacattttctgattttggtaaagagatgctagagattccaatatataagagaagtcacggaatttttaaacagtggcacacagacaaacacacaaatgcagccagccaaacaaaacatatctgcaagtcaggtttggcctaagcaaataatttagggtctataatgcagataaatccagaacacctcttactacaactaaaatctgaagaaaagtcttcctcctattctgcactgagtggaaaacactgattgctaacaactgtataagcagagttacatttgctttccatagtgtatttaattcagataaggtatctaataatacttactatgctcccctgtagatctgtgattctcaaaaagggatccccagacaagcactgggaacaaagcctgcaaacttgatagaaatgcaaatttctatcatatgcaaatcctatgccagacctccagaaactcagaagtggagcccaggaatctgtgtgctaacaagccctcaaagtgattctgacacatgccagtttgagaaccactgctctagaatgccatttcctgactttgctttccccacctgatttcctgtagactatgaggaatggtgtgatttacaggcagagagagcagaccatgtttcaatggctctgagagtgggaagacttctcaatgtctaaatgtggcagagccaggaatagctgcaagattcttaactcactttaccaccttagtttataagtgagattggcttcaaagagcattaaaaacaaatttttgcagtgctagtacgacataccctgtggaggtttctgatgacttttcacaaagtcagctccacataaatgattgagtttgcccttggacccatcattaaacagctgaactgacaggccctgtgagaagtagtgttccatttcccttagcttcagggcccctatgccatttgcacagtcaaccttaagtgatctgtattcatctccactgcaagaagcctacaaaggaaaaagacacatggaagaaaaatttcaagttataaaaataaatgtgaaatataaagcatatatacatatgtgcatatgtaaatatttagttaactcattttaatttttaaattttatcaattataattgtgttcatttttcaatttttaaaattataaaacactaaagtaaaatttaaaaacacctggaacaacagaatagttttgctgattgaacaacttatagcatagagctttattagaatttagtctcaattaacagggtctcttaaaagtaatattacaagggagccattcaaatgcaagaataagcacacagacaaatgggcagtaatgacatgtcattctttttatagtatgtgacatcatcatcaggcagatttgttttttttctaattgtctcctctcccagctatcctcaccccaaattataagttctatgagagcaagggcttttagttaattgtgcctggtaaggacatatactcaatatttgttgatcaaacgaattatacttctcaaatctctctacatttaacaagccaatatacctagaagaaaatctcaatagtacatgcctcaggtattaagccaacagcacctacattaactaagatcaaattcatctgaatgaatacttatgataccatcgtcaagacccccaccatgtttgcttccccaaagtatctcagaatgtactacataatttgccaagtaaacgccaatgtaagttagcaggatacatagaccagaaccttgtgtagccctagagaaaaacaaaaaaggagatatgcagcatctttggaaaaggaaagaggaggcatgacaaacaagataatttgttcagtagaccatgttactttattcatttgtttaactttaaccatgttcaataaacttttcacctgtttggtgagttccacaaaagccttagagagtttctggtagtaaccttctatagttgcctttccatatcggccacccgtgtttcgacaatacaccatgtagtgcagctggggtgttgttaacaagccataatctgtcatagaaatacaaaaagcaattcaccgcatttcttaacaaagagaaaaaagtttaaatgcattcatgtgtaggaatttcagggtgacaaatccttttgtgtcatctcagacatcttagaaaacataaaaatgatcttaaaaagaaatataaatgactataagaagccaaaaaaccaatcattacatataaacaggtaacaatgtaaatataaagcaatacagacaagtaataattgagttctgtttccagtaacattgcaaactacataattcagatgaatcatcctcctggaaacaaccaacatgctagataaaagacaaaaacctccttttaaaaagaactacagtgctgaaaagtgacagaattatcaggccaaaacatacccgaaggcaagaactccaagatctaagctagttcggaagccagttttgttctgaagttattcctctaaactagaaattgagctacggttttcagagcaaaaaaagcccatgctgatctaagatgcagaacccagtagaagaccagactctcatgaagttgaaatcccaaagaactatatcttcagtccgaggatgagtcagaaattaatcaccccatgtcaccattcccaggacagttatcttaacactgagcagggaagacgggaaaacccattcttgaagagctgttaccaagcacaggcccttgcatggacttcctgcccaacatacataaccacaggagtccaaaggaactttgtcatgaattttttttttttgagacggagtttcaccgtatcgctcaggctggagtgcaatggcgcaatctcagctcactacaacctccacctcccagcctcaagtgattctcctgccaagtagctgagattacaggcacccaccaccacgcccggctaatttttgtatttttagtagagacagggtttcatcatgttggccagactggtctcaaactcctgacctcaaatgatccacccacctcatactcccaaaatgctgggattacaggcatgagccaccacacccggcctgtcatgaatcaatttaaagtgaacccagccagtgccccaggtacccagcagaagccagactaaactttaccaaaggactatactttcattgtaaacctcaaaaacgtcccataattttcaaaaacaaaaagaaagaaaaccagcttacagttaaacatagctaacatataagaaaagcaccatgagcaaaaaacaaagaaaaatggatcgcaaagatggaccagtaaccaataagtaaatactcagtgactacacctgtcagttggacctgaacctcaaacacaagaatttgactgcaggcaaaaaggagtcactttaaattcttgagccctgaagttatttaacagaaatggtaccttatgaaggcaaccttagctctggtataatgatgagatgggaggagatggagaagctcaaaaaatacaaataagagcttagattagtttaatggaagtgtttactagaggaacccattattctaaaagacatgctaaagtaagaaacaaaataattttgtgaccaatatcaaaattaccaaataaacatttactaaatgactagtatatatacccagtgaaaagcattatctatccaactcatcaactcagaaacctggaatgtgttcttcacagttctgttctccccatatatcacaaaatcctttgaatgcaataccaatttttcaagagcggcctagctggtctgtttccctttcttaacaactttcctttcccttctctctgtgacaaacagagggactggcttaaatgaaaatgtgatcatatcactctcttgcataaaatccttcaatggagtcccattgcatctggaatagagcccaagttcttgccatgacctccaagatttgtatgaattagtcccaccttacctccctactctcttctcctagcccctcttctccctatgttgcagctacattaaccttttttcatttactgaaatacactaagctgaagagagaaatgaaggaaaggttaaaaaaattactctcaactttttctagactaaaacactagaagagtgatggttctagcgacagaatgaaaatgctgaaaaagacaaccattctggggatgacagaaagaatacagtttggggcagggtgaacatgagacagaagcaggccacctaagggaagacaccactcagaccaatgctttacaaactgcaggccacagcctgccaatgggccatggaatttacttagtgagacacaaccagcatttgtgcattttaaacagatgactgcatgtcatgtaggctggatgagcattgtttattgaaactattatttcagttatacacacaagcacacattgacatgtcatgacacataatgggtttcttactatgggttgtgatacacagtgaaacagaaatagactactagagggatgtacacagcaggtagtaaaacatgtttgatgaattaacaaatgaatgaggccgggcgcagtggctcatgcctgtaatcccagcactttgggaggccgaggcaggcggatcacgaggtcaggagattgagaccagtctggccaacatgatgaaacgccatctctactaatacaaaaattatccaggtgtggtggcatgtgcctgtaatcccagctactcgggaggctgaggcaggagaatcgcttgaaccagggagtcagaagttgcagtgagccaagatcgagcctctgcactccagcctggcgacaaagtgagactccatctcaaacaataaataaataaataagtaaataaataaataaataaatgaaaaaaggtagctcaagctatggcagtagagataatcattcagaaatcatgcagaatgaaagagggtcccgaggaatgccctccctgaaagagacagaagaggagccaacagagaagaccaatatggaatagtggccaagcaagtagaagctcaaagaaagagctttaacattatggaaagctacaaagacttcaactgtaagatctttaaagcataaattattaaaattatttttagatcacagccccctctgagtatctgaggagaggtacgcatgcactccctgggaaagtgcttgtgccggcaacactctgtacatcgtatcatgaggtccacaggtcctctgcagctttcccagacatgccacagaggtccctggttaataatccctactttacaatacccaccagatttggcaataacaatgcagatggatgtcaggggtgggctggggagacatttatttcaaggagaggtaaggatacagactcacctgcagaaagctgaagaatgacagaagaggaggaaacagagaaggtaagcagagctagccctcagcagaggccagactgaccgtgcaggaagggaacacagtcggaactcgagaggaggtttcaaaggtcaagagtggacgtttgttttaatgagaaagatctcacaccaggaaaatattcacctcaaaacatggtggaggcagtgccttcacaacagacacagtgtgagaaggggatcctagtctgttttgtttcacttaattctctgtcatttgatataacataaagaactacctgtcaaaaatatttcccatcactacttgacaggtaacagctgatttcacagggaaccagctattagggaagacctaataatattgataaaagctccccagaatgatcatcttcaagtacttaaaaaggtttttatttgaggaaattcagccttaccaaagtaaaggaagttgtattagttcagaatttcccagctataatctcctatagtactaccataggtaagacaaaacatgcctgcccagaaacgacctggaagatgatttttaaagttagtattttgtatctaggagttcattttttaaacattttttgttcatctgtattttcaaacttttctaaataaatatacattacttttgtaaattaaagttttttaaatattagtttaatttccaactcaggataactacataccatggaattgacctcctagaacagtcacaccatctattacagattgtgaaagtttctcactgctgggcctaggaaagaaaaggaagaaaataatatatcccatcctgaaactggcagggttgctggttctgcaagcaaatgcaaaaattacatgctacaaatttcaaaatagtaagttcctggtatctgaactgaaagctatgaactctcaagataactggtaaattataagcattttccagtagcctttcacaatctagttctaggaaaaattctggcttttaaatgaatttataaaatagatataaaggacactctaaccacagcatacccaaataccttttcaagttcgactacagcaacatgtctgaactctaagaacagtaacaataaacactgaatatacacagtgtgtataagacagtacttgtattaagctgccaaggatatagaacctgttttccattttgtaaagtcagaacaaattatctatctgaaaataaaacagattacaaaactgccttggccaggcacagtggctcacacctgtaatcccagcactttgggaggccgaggtgggtggatcacaagattgagaccatcctggccaacacggtgaaaccacgtctctactaaaaatacaaaaattagctgggcgtggtggcacacagctgtagtcccagctactcgggaggctgaggcaggagaatcacttgaccctgggagtcagagggtgcaatgagccaagactgtgccactgcactccagcctggtgacagagcgagactccgtatcaaaaaaataaaaaataataaaaaaactgccttgtaggaaaaaacgtttcatcacttacattagttaatagttaagaaccaaatacatgtgggatgactttactgtggtgggataatttacttcagaacataagttactctgctaccatcgtcggtatctggaaaaccctctggtaatacaacagagggtaaaaaaaccagtccaggtattggagattgagtagaaatttccttttgaaataatctcaggttaaaaccagatcttatgcaaaaggaaatgctactgttgcaaagtatacttttcatctaatattttacaaaaagacatttttgttaagaaaggcaaaagctgcaaaacagaactatgtggaaaataatattgtagtttacagtgagctccagcatgggaaaatgatataaatatttgaaacaataataacacagattacaaagtaaatctttaaaaataatgagttcaaatcatgtgttgactctgtagggaaaaaaaaataaacctacagagggggtgggagacatttattgagtgcttctcttgtgtcaggaagtattttacatacattattctgcagcttgggttttggagtagggttttaaaccagagtcagactccaaaccccaagctgcagtagtgacttagctactacatcctactagaaaggccaggcaggtagacatgcaactcagggtagttccactttacttctttccatttgtcttggattaaaactgatacaatcgtttatatcacgttcccaaaggtttttttttttaccagtaactcttatcatcacctggtatctctaccaataactacaaaggcatcttgttgcagattcacagcttctttctcgctgatgtcaataagcactctctgcatatcttgttcctcagcatttgctaaacaggtggcatgttcctcccaggatggtgccaacatttcacccaaaggatcaaccaattttacaccattgtcttccttaaaagaaaaacaaacaataagcaatctgtgcatactcatgaggctgagttgagaacagaactcaaaagctgtttcccttcaaccaaagacagtgatggctgagcagcttcaacaataaacaccaaatattaatactggaccctggattaggtattttatgtatatatattacctcattaaatcctcatgacacacataatcaattaaactaataatcctattttaatttcaatcttcgagaaaactgagcttcagagaggttaggtaatttgcttatgatcatacagctaacaaatgtcagtactgatattaaaacagcaagtctatcttactcgcctaaaaacactatgccacactagcctttgtaaaaggctgtgatctgtgcatccactatccataaactgactagggcacaagtggagcagaataagggcacacagagatccttctcactatgactcggaactccaagaacacactagccagcttgtcaaccagcgggtaggacagacactgaaaactgcctcccaacactgttctgctcaaattcgtggaaagaaagtgtagttcacagtgaatgtcacctgaaagaaaagagaatcattttgagaagtgcctctggaactagcaataaatgtgagggtcttcctagaagtcaatcagtcaatcaattatggtgacttacatatttagacatatacacatttataatgatcacatatttggacaagcaatgcccttgtttgggggaagaggaggttacaatccttcacagacctacaccactttaacttgctgctgatttagctacaaaggcaaaaatcccacagccccagcaatcaaatagaagcatattattcaaaccctgtattaatggcctatagctaataaagaataactacattgtgtcaagaggttggctaagatatagaaacaacaaaagtgctcataaacagataaatggatgaagaaaatgtggtatatatacacaatagaatattattcagccttaaaaaagaaatactgccatttgcatcatggttgaatctggaagacattatgcgaagttaaataagccagacacatgaagacaaatactgcaggctcataacatacatgtgttatgtaaaaaagtgaaactcacagaaacacagagtagtatggtggcggctagagggtaagggaaatggggagatgctggccaatgggcataaacttgcagttataagatgaataagttctggaagactaacgtacagcgtggtgactatagttcataataatatatattgaaaatgtgttgagcgtacgtcttaagtattcccaccacaaaacaaggtaactatgtgagctaatggatatgttaattagcctgatagtggtaatcatttcacaatgtatacatatatcaaaacatggtgttgtatgacttgaattatacaatttttatttatcacttatacctcaataaagctgaaaaaataattgtgtcaaaaagaatactttgattaaaatctaactgtcacaaagactagaactatcaggcgtcatcaatattctgccaaagctcacctgtttgttcattcagaacaagaaattattgccgagctataaaaacctgtctgaaaatgttcaaaatgtttcttttcaaatctttacccttccccacccaaccccaatatctttaatcactgctaagttaacaaaggaaacaattttcaattactgaaaatgtcttaaatcaataaatttggaaggacattgttatttctctaatatggacactccaaaaaatgacagtatcttttcattctttccacacccttaggaatcatgagcttaatgatcatgctcttaaaaaaaaaaagttgtttcacatccaaagcacatataaatgagaaggcacattcctagaattagaatttgtactttaggtcaatttgctcagacactaaggcttggtcttgtaaataatggtctgctttatcagggcactaaacccattacctcaggattgtgggacgctgttaccatgactcctatagtggattttgtctgttttgacctcaggacagctaataatcccatgcgaaacatgacatgatcaagatgttctgccttcgttcgaaatccagcagtcccgtattgaaggatcagtccattgggcttggcgtgtaatgctgagtattttgtaatagcacctaaatccatgtctacaaaattaagaaatattgtttcgggcataacaagtaatttcttaagaaccatttgcttcaaaaactgccaccccaaacgaataggtctgtctcatcctgaacctcctcaaagaaccctatgtttgacagagcaatgggcaggagagtaagtcctgtgggttagaattacctacaagatgttgtccaacttggtatgtccactcctgggcagactcagggcagatagcagattgtccccactctcctcccattttagctccaggactatcctggacgccgggcacacttaaattggtccactctcaactaaaatgaagattttacacctattcagagactccaatgagctcaaagatcatttcattttacaaaaagggaaactaacctaaattaacatagatagctggtgacggattgaggcctaaagtcagattcttgagtggactgaaactacatatccccaaatatctgagaaatctttgtggttcttttgctatttctcccaaactacagagacatattcttaaaggaaaagcaaaaggcaacagtttcttctccaagactacccagatctttttccatttgctaaaaacaatcaggacacccttctaagatgttgctctaaaactagcaatatcttcttctgaaagaatgccacctttttcctttacttttaaaaataaaacatcggccgggagcggtggctcacgccagtaatcttagcactttgagaggccaaggcaggcggatcacctgaggtcaggagtttgaaaccagcctggccaacatggcgaaaccgcctctctattaaaaatacaaaaaaattagtcgggcgtgttagctggcgcctgtaatcccagctactcgggaggcagaggttgcagtgagccgagatcgcgccactgcactccagcctgggtgacaaagggagactcggtctcaaaaaaaaaaaaaaaaaaaaaaaacaggccaggtgaggtggctcaggcctgtaatcccggcattttgggaggccaaggcgggcggatcacgaggtcaggaattcaagaccagcctgaccaacatggtgagacccttgtctctactaaaaatacaaaaagtagcctggcgtggtggtgcgcgcctgtagtcccagctactcaggaggctgacgcaggagaatcgcttgaacccgcgggtggaggtcgcagtgagccgagatcgcgccactgcactccaggctgggcgacagggtgagactccgtctcaaaacaaacaacaacaaaaaatcggcccttagcccactaatactgttttctctgggatactcccattaagtggaacttggggtttccaacctcagtcagtagttttccttcagtagtccatatactacatttcctgggtcaattaattcccaattagcccagagatgaggagcagtccgccagctgctagcctcataattttgttttctttattgtccttcattgcttcaatgaacagaacttgcaagaaatggtgaaaaatacttgcttttgtccagttggaaaaagctggcattcagtaaactaatttagttcaagacagtgatcagatctctttcctaaggatgaatacatatttgtaaaaactgagcagtcagttatgtgtcatgattattcataagagtgtaaaccagtcctgttaactccaaaaagccattaaaaaaaaaaaggtccagataatatgagttcatcctttcatgcgttttaggccctacaactactttcaatgcctctgcgaatgcctttattgaaagcatatttgccaaatccagcgtccacgcaaaaagttaagagtatccccctactctccattcaatcttcaaatctccttggtgcctctctcccgcctaccctcgaatcaccgcacaagggtgattcccggcactccaccctgaggtccccgcctaggtccacgtaccagagccccggcaggagacccgcggcccgtcccgaccagcccgcccgcggggcgcaggggcctgtaggtgtgtcccgcgcgctccgccgctcggtcagtcgcccgccagaccactagcccctccgtcgggccgagaatctgacctgtcccgctcccaccgagcccttgccgaccggtagtctcccttctcaactccgagcctcggggcccggcttacctcggtcaggaagcccccttcacctacacgcagcggagaagcgcccaagcaacaacgtctgcacccaaacccagtcctcagaaccgcagacgtggccctgcgtggcttccggctc

SEQ ID NO: 1903 - DNA, 28420 bp, Homo sapiens; identical to SEQ ID NO: 1902

SEQ ID NO: 1904 - DNA, 27164 bp, Homo sapiens
ttcaaaacaacgaatttttttatttttcactcagctcatgaggcacccatttattgagctttttcaccttttcaatttgcttcaaatgccgaacgaccataaaatggtcaacattgagttcttgggcagctctcttatagttgtaagaggatcagcttcgatgatgttctcaattggtcattatcaatttccgatgactggccactgcactcctcatcttcaaggctctagtctcctttgcaaaacttcttgagccatcacggcactgtatgttcattagcagttcctgggccaaatgcattgttgatgttgtgtgttgtctctgctgctttataacctattttgaactcagaaaatcgctaaatttgatttttgtctaacatcatttccatagtctaaaataaatataaacagcaataagtcattagcaaaaaaaaagtgagaaatatgcttaaaatgatgtataacataaccacatttatttaagaatgtactccaatataaaacggcaaatttcaacaatgcaaaaaccgcaattacgtttgcaccaacctaatattttcctttttcaggattttactttaaaataagcaataagcttgagagcacatagaagaaaataagctggattttgcatctgcttgacccactaggaaactagtgatattaaattattaggtaaacaatgaaagtttctgagcaacatctgatcttagaaggcaaactccatttgttaatatgacagattgtaattctgcttcctaagtcttcatgatttcttccttctgtctagttcattgcttattttcattctttagtgtggaattgtatctgtgattctgcccaagttcaaccaacctgttctctcttatctttctctagacagaatgatgtctgtagctgtgtttgtgtaattcaggtggcttctcaaactagcctcttaatacccaaattattagtctttatatttagttgacagagttttcacataccttctcatttgacttctctactaaaaggtagttttagactgtcccattttataagtgaggaacctttgtatatcctgcccaagggtgccgtaagtatggcagagccagcacactaactcaattcctttgactccaggtccagctttcctccctatgttgtttagcacaacccagaaggagacagcagtgtctcctgagggatcccttcctttctctgtgatgcagtactgacagtaattattcactttggacactgctaccatcatggcaaatttaggccatttagataaaagggaattaactaattataataaaaggggatatattatgaaatgtataaagcactttgttccttttttctgtagtaattttgtgacctagtccttggttacagtagtgagggttcagaaacctgggagctttttgagtaaatacaaagcacaacataaaacttttatgtttgactctattcctgttcaaagctatttctgttaactaagcttatctgcgcattctagttgggaactattactacaatgttagactgctccatgtaaaactaataaatggcagtaaaaggtctcagaagcaccaagggttttgatcaggtcaggagttagaaacttaatgtcatttgtattcatttcttgaccaattgccaaagtttatatatttttaatttttctaacataccacattgtctgttgtattaataccagttcactttttgttttctgcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatataggtaagtcatctaataatctttcttaagactctgcaatggaaaaactggttgtataaagtcttctctgccctctccatttgtatcagcaatggggaatgctgcaaaacatcatcttgctcatgtgatggtgatggcaaagatatcacaaggagttggtaataagatttaattttccagtagcctgcatgaattgttccccacataaaactgtacagttagtgactgaattgtatacttaagtcccagtattttacattagtgagactgaaattagaggtaaatttctttaacaagtgtaaggcttacctatttataaagaattattctgttagtgtttaagaaaaacagatctagagacaatccagtaggctgcattgtaaacattatgattataaatctcttagtactgccattattattgacagttttgtaaagacttgtaaaaagtccagtttctcaggaatatgaaaattatcttcagaaacctggttggggcctttctccaattcctccagccagctgaaatactgccaagctcacttcatgtgcaaggtgatctgcactttcctgcaaattacattaaaagagattagatgagaaagacatagcatgtgtctaacatgggcaagaccatgttacttggaactctggggaagagaggggtgattcttgattttgtttcactaacaaattctaatgaaaaccttttttcatctttcagtaacaaattccaaagcccttaaataaacggaaaacagaccaaattcttctaaataaggtaagtttttaatcaattcagattataaaaatagctatcattccacaactgaaaaaattcaataaaactttaatccacaattggcctaacagtaagtaagtactaatgcctctgttgccatctcctcatccatcatggatattcattagactctgagatggcttaagcttctgcaggaaagctgccaaatgtctcctcctgattccctattcagcgcactcactgtactttgccctggctttgcacacactttaaggagtatgtgaagaggccaaataataaaaatccagaccacaagtcttgacccctgtcagggaaacaggcacagagtaaggctgtcatttaaaggaaatattttgaaaaacaaatcaagagtccagaatgctatcagttgacttagaaatgaactacaaagctggttgttttcatgtcacaagagtatatttttaaaagaagagaaaaggatcatctaccttatagtgcataaactaagtatttattagttattcctgccatggttaaaaatatgacactttcaggaagtctagaataagtcaaaaatatttggggaaataaactaagtgggtctaattttgttaaattgtataattactgctggtgaaaataattttgtagtcttaatgtgaacctaaaaggctcaacaaaataaagccttaatcatcatagtgagattctaaaaaccattaaaatagtttgcctgcccatcacctaatattaggctctttttcaatagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgatgcgtcattcatattatttattatatcataaagttggaaaccaaatacttcacagacaatagaatgttaagtaaatgaacttagttattctataatttttttttcagctgtaagagaatacaattaggtatcataaggccttctttttttgttttgagacggagtctcgctctgtcgccaggccagagtgcaatggcataatctcggctcactgcaacctctgcctcccaggttcaagtgattctcctgcctcagcctcccaagtagctgggactacaggtgtgtgccaccacgcccagctaatttttgtatttttagtagacagggttttaccatgttggccaggctggtctcaatcccttgacctcatgatccgcccgctttggcctcccaaagtgctgggattaaaggcatgagccacgagctactgcgcttggcccataaggccttattttctatgtatcatatgtgtatgtacagaatgaaataggaaacatatgtcagtgagatataatgagaattgggataataggttttacttagctaatattcaaaaaagttactttaaagtttctctcacacctgaactttaagttgtctgtttggaagatctgtatagagagcatcccactgttgtacagtcaagcccttcagagccaagattgcttcaatcaccagcatgtcagaaatagcatcaccagctgcctgcaaatggggaaacaaatggaagaaaccacttaacacaagcaaatcttggaaatggatgttttttcttagaaaaccaatcacagtacaggttgaacaacctgaatctgaaacatgctgagtgccaaaataatcacaagtgaaaaattccacacctggcctcctgtgacaggtcaaaatgtgggtatacaactgccaggtgtggtggcatacacctacagtcccagctactcaggagaggctgagatgggatgattacttgaagctaggagtttgaggctgcagtgtgctgtgataatgcctgtgaacagccaatgcactccagcctgggcaacatagcaagaccttgtctcttaataaaaaacaaatgcactcctgacctcactgtcaggaatttgaaaccagcctggccaacatggtaaaacgccatctatactaaaaatacaaaaattagctaggtgtggtagtgggcgcctgtaatcccatctactcgggaggctgaggcaggagaattgcttgagcccgggaggcagaggttgcagtgagccaagattgcgccactgcactccagcgtgggcaacagagcgagactccatctcaaaacaaaacaacaacaacaacaaaaaaaacccactaaaggcaggcccgcagttcattcagcatccccaagggaaaaagaccctctcagcctccttcagctatgatacatcgtttccatgcatgccagatatgtatcatattttttactattaaaatacttgtgtgtgaataagtgtaaaaaaatgattgattgcttattgattgatagcatataaattcagagttttaggaatgatggtgatgccagacaaccacagattgtccaacgggtggctgacagagtgacacctttgctttctgatggttcagtagacacaaactttgtttcatgcactaaatttacagtattctataaaaccacctttaatcttatgtaacatacatgaaacaaaagaatttagtgtttccgacttgagtgccatacccaagatgtcacattatatatatgcaaatatcccaaaatccagtgaatctggaacccaaaacacttctagtcccatgcattttggataagggatactcagcctatatcatgtgctttctcacatgcagcatgattaaatgaagtgtttttgtggatggataaaatacgaacaatgaggtgaagatctctgtggaagacaatgaaaggtataacaaagaatactgaaactagctcttgagaaacttgcctttagtactccttatttataaaatgaaattagactggataactctaaggctcagcctaacattccatcactcatttttctttttataaatagatcccttttgagatattaccccacaatgattgatagaaagcatcaaggtaaaatggagaaatatgagctttggtataagatataactgaagataaatctctgtttcttcacttataaaatggaaattacagtaacacctctccctgtgttactgtaaggattacacagcaaggtatataaagtgtccagtgtgtgcaagacactcaaataattgaatcgctttcctctaccctgagtactgcttttccatagccaaacgacactccaaccccaactaacccacatgtatgtcctttgtcaatgagacaaccagttatttgtgtttgtttttgagacagagtctcgctctgtcacccaggctggagtgcagtggcgtgatcttggctcactgcaagctctgcctcccgggttcacaccatgctcctgcctcagcctcccgagtagctgggactacaggtgcccgccaccatgcccggctaattttttgtatttttagtagagacgaggtttcaccctgttagccaggagggtctcgatctcctgacctcgtgatccgccctccttggcctcccaaagggctgggattacaggcatgagccaccgtgcctggcctgacaaccagttatttttacttaatttcatcgaggtttggttaaaaaaaaattaataatatatatgtatacactgagtagctgaatctgtgatcctaggtagaagctacccaatatacttgaaaatttccatcataagaggtaggggaagggaagcatattaaaaaatgttctgtcattccatttcattataaatctcaactgaatataccactattagaaggaagccaccaggccaggacgtctccactttaattttgtatgcacccacactctgttctgtccatcttctgaataatgtaaaggtaaccaagagtccactgccccatcagttctgacctggttaaacaagtcaataatgttttcaagcatcttagcagcttttcttttcttatcttccagttgttctgctgattgttttatcttcatttcaacagctgtactaaacagtgcctgcagcaaaagaatataaaatcagtctcaaaacactatccaaaacctagtcataagtactattattctagctaacccacttttccctcctagtcaatctggagaaactgaggggaaaaatagtggcagccttaaaatgtatgaaattaatgtaagatcacattaaaacccagaggatagtactaggggaaaaattttatttgcggattatataactggttataaaaatttaaacatctgattacaaagaaaacaccaccttgacaagaggcaagcacacacagtaagttcatgttttccctttaaccagctaaatcatttctgtgcaaccaggttacttagagcctgtctgtatcctttttactttgaaggatataattcattgcagctagtatagttttattctaaaacttaaggggatgagctaggcaaaattaagagttcatagtattcatcaaaatatggcaaataatgtcatggatagtcattacaatatataattcatcatgctcctcaagagtcttatctcatttggaaatactcatcttttttactgccttctagaggcctaatactgagcaagattagcatactatgctcaactacttgatgaaatacatttttcttgataaaataaggcacaggctagtcacctgtttttgtaaagttttactggaacacaaccacacagattcatttaagctagatcagcagagttaaacaactgtaagagaccttatggcctgaaaatccaaaaatatttactctctaccctttagaaaataatttaccaacttctccattcgatcactaaagttatatcttaattgcattttgtaggaacttatttttcccctttttatatttatgccctccaaaagccaattttaaattaatgaggaaaattatttggctttgattcaaatgttctgatagccacctcaagtgtattcattaaatgaggtgagtataaaaacattttaaaaatattctgaacattatgaatctacaaaaaactaaattatacactttaaaatgtaattttatgtaaaatgtaaattgaaacattttatgcctatcactagttaccttaaattcattttcatttcttattaattatcaactttccaacactttgcaattcaccatagcgactgaatttttcttttcctctcctatggccagccggaaaatgcatagacaacatacttataaaaaaattaagaactgtaaattttaaaaaactattcaaaacaccttagtatatctcttcacattcaaagaagaatcattaccatgtaaaagagaatcacagtttcataatacatcaatatataagataaccaaaggatctttttgtcacatccaattatttcaacaaagtacaatattacctattattacctcccagatatagaagtctcatcataaagaaaagtgccagctaaggccaactataattaagagaacttacagtgccatgcccatttgcttcaaaataaactccaatgtcaaactcttgagccttgtggtgcaaatgttttacaccagtcttagtgcaatagacaggtacctataacacatgcatttaaagaaatacagcaattactcagatgtcaaatgtttcttgcatacctagtatcccagagatacaaaggggaacaaaatactggggccgagtccagtgaggaagacgattaagcattaaaatacaaaatggtacgtatacaatggaagcatgaacacactctggaagcacgcagccaagggtaaagcacggtgagagagatgagggtctccttataagacacgaaagattacaagtgggggcgtgacatgacctaactgttttagaaagctgtttagctacagtgtggagaatagcttagagcagaattgcaagctttttctgtaacaggccagacagtaaatattttaggctttgcaggccatatggtctctgtcacaattactctgccattacagtgcaaaagcagccacagaccatacataaacaaatcaacatagctctattccaataaaactttgtttgcaaatagcagcaagttcaattagaaggttaagaaatggaatgaggaggcttctaggactaatcccagtaagaaatagtggctggatcagcaatagtgaatagggaaagtcatggatggatggatctgagagagctttaagaatggttaaggaaagattgatagtagaaaaactgcaaaagaaagatcagcattagattggatgtaggagacctcaggaatggcaagggctaaaaatatttcatctggaagacagtgagttgagaagtaacagtttcttaaactaggttattttatctgtaataaatttttaagacagaaaatgaaaatcctaaaacaataacccaagtactgtgaaataacccaatccctgtgaaaggcaggcaaatgggccccagatggaatcccttgaatgagcttattataaccatatattaaaatcaggtcataaactagcagcctcaagatatatttcgttttgcccagccactgtttctttttaaacaaataggaacatcacatgaaaattcagatttcctgcttctcttgaagagtgtgactacagttgacatcagctggcacatactgacctgtttttagccccctgctgccctcattcactttacctgtccaaatcctgcaggaatctgactttgtaattcctgctttctagagaatggaaaggtaactaaaactagtataaatgccagaacgaggtacaaaatgaggtacaaaaaagttggaaaacttctcgataatgagaaagtataggcaaacagacttccagttttgtccatgaaccctggtaactctccgagcaagtagtgtggtgccaagggtggtcacctggtggacaccggggaaataattagaaacagaatctcccaccaccccagaaaacctctccaaaaaaaaaagaagggtaagaaacagttttattactgaataagtattaagccaaactgatgttcaatcacaggctaatttgctaagagatagcaaagataaacgctcaccctttaatatagccaagcggacacattccaatacaatttgctaagataaaagatggctaatgacaaaaattctctccttgaccaaactttagttaggtttaggtgggcctgactaggccttgtccttaggcatgtcttccaatagcccgattttaataagagtcatgctaagtgagcttagcgagaatccctcatcctgatacatgaccactcttgacatctgatctgagttctcattctctaccatcccccaggtaatatgtgaccgccctggcctaccttcagcaaaagtcctgttagatcagtttagccaaaataccacccacttaccctcatgtttcctctcagtaatttttcatccactgaccaccccccacacaccctgctccttggctataaagccctacttttccttactatatttggagttgagcccaatctttctcctaccactgcaaaactccatcacattagtccctgtacctatcacaacagtcctgaatcaagtctgccttaccattttaacaagtgtcatgaattattttttctttaacactagtcctcaaataggaaaacttgaaaccaccatttgtcacacacatagtttatcctaaacttacttggtaatagggatggccacctgtgttaactgcccttctctaaaggagtaataaaacttttcatacctctgtgacaggtagatagttacaaattggacgcaaacacctaagttaaactctcctgagactgggagataggtgagctatcttccttgatgtttatatttgaaattggtgactctaggcccttaaagaaaagtattcctgagctataaaactggcttattaggcctttagaaagacttacattcattacaaaggcacagagaaagaattccaagttttctaaaggaaaactccaagaaaaggaaggaaagaagttttcctttattcatcaaggacaactaaattttttcttatttatttctctttacctttacatgaacagcagctcagcttcatgcactacaacataatcacttttatgagggcagtatctttctcacagaaacatgatcttaattaagaaactaccagaaaacaaaaatggttcaataccttcataacttcttcaagataccgtgttgaacttccatttgcatatgcagtttgtacaacaccaatattcaaactttctccaatctagacaaaaacaatgatacttaacttgccatcaaaagtatggtctacaaaaacaaatataatgagagttctaaaggctaccaaaattatcagccagttcagttgtgccttagtttatgccaaaaatgtctgactgaaaatttacatgtatgccaggaaaaaagcctaaaatacatttgaacactatttaaaacaattctatgagaattcctcttttaagaagcctgtatctcctgatcttcacctctttaattttttaaataaaagtatctggccaggcacggtggctcacgcctgtaatcccagcactctgggaggccaaggtgggtggatcacctgaggtcaaaagttcgagaccagcctggccaacatggtgaaaccccatctctactaaaagtacaaaaattagccaggtgtggtggcatgcatctgtaatcccagctacttgggaggctgaggcagaagaattgcttgagcccagggaggcagaggttgcaatgagccgagatcacgcccctgcactccagcctgggcaacagagcaacactgtctcaaaaaaaaaaaaaaaaaaaatctattaaattcttaaagtatgctgtttccagattataataatttccaattacattgtgtacttaaagctagcctgagatttatttctaaaatagcaaaatgaaacaaatctcacattactaagcttatcataatcagttaatatatcagatgatgagatttcctattagaatttagggcttttatggagtgaccacagaactgtcatcaaagtttcaattatgatggaagcaaaacttcctaaagcttcaaatcacaaaactcagccagtataaggaggaaaagagtaccttcaggttccaaagccaatgcctcaaatgttcaaatgactgggtattaccactgctctttttttaattttctgcccactaatgtaaagaatttgtcataaattgtgcccttctgacaaatgattgtaaaatatggaactatttcactactaagtcttgttttagagggtagccaatccccccaccatacctccaccaggagctctttaaggaaactgctaattaacgttgctatcttgtctccatctatgagatgaaagtggccatctgcatcatggtagtaataaacaattctgtctgcatctccatcaaaagaacagcatctttcattggacttaatttccattcctagcacacaggataatttaacatgcatttcagtctaagaatttattataaagagttttagaattttctcttaaaattatccacctaaaaatcaatgtcttaatcttaaatagtgtataatctttaaatagtacatagtttattagtggtttttacaggtcaaattctttcactgcaaagtgaaaaaaggagcattcaaaatctatgctgatatttgctataatactaccataaaattccactttataagcaggttggtttggctagacaggtgtcccataaaggttttttgaaagctacatgtatttctgaatgtaatttacctaggaccgtgatctcctttacatagaaaaaataatcagcactagatgatgtatgtgctttaattctaacagaaatgatttttatttgttcataccaccaataaaaagaaacactgataattaagagcaaagaattataactttgagagataactggcctgtgaaatttacataaagttgctgaaatctcagcaattgtcacatcaaatttattagaaaatttggctattccttagccatgacagcagcagagtgacaaattcaacatgagacaactaagaagtaaaaggcttttgtcaggaatgggatcataagattgatgaaaggacatgatgcaagcttcaggaaagcaaggactatggttttgttcatactgtagtcccaaagcctagagcatagagagtaagagctcagtatttaagaaatggataaataagtggcagaactgaactgtcaagtaaatgtcaaaacaagcaattcaatgaaaaggagctcaaattggttgactacactgacattttaaatgcttactaagtaaagcataataacatgaatgaatgaggcaactggatgaagtctgtagagttccagaatgcatgtcctattttaggggagcagcatctatctgactgtagtggactaatgccatgtgtgaacattttctgattttggtaaagagatgctagagattccaatatataagagaagtcacggaatttttaaacagtggcacacagacaaacacacaaatgcagccagccaaacaaaacatatctgcaagtcaggtttggcctaagcaaataatttagggtctataatgcagataaatccagaacacctcttactacaactaaaatctgaagaaaagtcttcctcctattctgcactgagtggaaaacactgattgctaacaactgtataagcagagttacatttgctttccatagtgtatttaattcagataaggtatctaataatacttactatgctcccctgtagatctgtgattctcaaaaagggatccccagacaagcactgggaacaaagcctgcaaacttgatagaaatgcaaatttctatcatatgcaaatcctatgccagacctccagaaactcagaagtggagcccaggaatctgtgtgctaacaagccctcaaagtgattctgacacatgccagtttgagaaccactgctctagaatgccatttcctgactttgctttccccacctgatttcctgtagactatgaggaatggtgtgatttacaggcagagagagcagaccatgtttcaatggctctgagagtgggaagacttctcaatgtctaaatgtggcagagccaggaatagctgcaagattcttaactcactttaccaccttagtttataagtgagattggcttcaaagagcattaaaaacaaatttttgcagtgctagtacgacataccctgtggaggtttctgatgacttttcacaaagtcagctccacataaatgattgagtttgcccttggacccatcattaaacagctgaactgacaggccctgtgagaagtagtgttccatttcccttagcttcagggcccctatgccatttgcacagtcaaccttaagtgatctgtattcatctccactgcaagaagcctacaaaggaaaaagacacatggaagaaaaatttcaagttataaaaataaatgtgaaatataaagcatatatacatatgtgcatatgtaaatatttagttaactcattttaatttttaaattttatcaattataattgtgttcatttttcaatttttaaaattataaaacactaaagtaaaatttaaaaacacctggaacaacagaatagttttgctgattgaacaacttatagcatagagctttattagaatttagtctcaattaacagggtctcttaaaagtaatattacaagggagccattcaaatgcaagaataagcacacagacaaatgggcagtaatgacatgtcattctttttatagtatgtgacatcatcatcaggcagatttgttttttttctaattgtctcctctcccagctatcctcaccccaaattataagttctatgagagcaagggcttttagttaattgtgcctggtaaggacatatactcaatatttgttgatcaaacgaattatacttctcaaatctctctacatttaacaagccaatatacctagaagaaaatctcaatagtacatgcctcaggtattaagccaacagcacctacattaactaagatcaaattcatctgaatgaatacttatgataccatcgtcaagacccccaccatgtttgcttccccaaagtatctcagaatgtactacataatttgccaagtaaacgccaatgtaagttagcaggatacatagaccagaaccttgtgtagccctagagaaaaacaaaaaaggagatatgcagcatctttggaaaaggaaagaggaggcatgacaaacaagataatttgttcagtagaccatgttactttattcatttgtttaactttaaccatgttcaataaacttttcacctgtttggtgagttccacaaaagccttagagagtttctggtagtaaccttctatagttgcctttccatatcggccacccgtgtttcgacaatacaccatgtagtgcagctggggtgttgttaacaagccataatctgtcatagaaatacaaaaagcaattcaccgcatttcttaacaaagagaaaaaagtttaaatgcattcatgtgtaggaatttcagggtgacaaatccttttgtgtcatctcagacatcttagaaaacataaaaatgatcttaaaaagaaatataaatgactataagaagccaaaaaaccaatcattacatataaacaggtaacaatgtaaatataaagcaatacagacaagtaataattgagttctgtttccagtaacattgcaaactacataattcagatgaatcatcctcctggaaacaaccaacatgctagataaaagacaaaaacctccttttaaaaagaactacagtgctgaaaagtgacagaattatcaggccaaaacatacccgaaggcaagaactccaagatctaagctagttcggaagccagttttgttctgaagttattcctctaaactagaaattgagctacggttttcagagcaaaaaaagcccatgctgatctaagatgcagaacccagtagaagaccagactctcatgaagttgaaatcccaaagaactatatcttcagtccgaggatgagtcagaaattaatcaccccatgtcaccattcccaggacagttatcttaacactgagcagggaagacgggaaaacccattcttgaagagctgttaccaagcacaggcccttgcatggacttcctgcccaacatacataaccacaggagtccaaaggaactttgtcatgaattttttttttttgagacggagtttcaccgtatcgctcaggctggagtgcaatggcgcaatctcagctcactacaacctccacctcccagcctcaagtgattctcctgccaagtagctgagattacaggcacccaccaccacgcccggctaatttttgtatttttagtagagacagggtttcatcatgttggccagactggtctcaaactcctgacctcaaatgatccacccacctcatactcccaaaatgctgggattacaggcatgagccaccacacccggcctgtcatgaatcaatttaaagtgaacccagccagtgccccaggtacccagcagaagccagactaaactttaccaaaggactatactttcattgtaaacctcaaaaacgtcccataattttcaaaaacaaaaagaaagaaaaccagcttacagttaaacatagctaacatataagaaaagcaccatgagcaaaaaacaaagaaaaatggatcgcaaagatggaccagtaaccaataagtaaatactcagtgactacacctgtcagttggacctgaacctcaaacacaagaatttgactgcaggcaaaaaggagtcactttaaattcttgagccctgaagttatttaacagaaatggtaccttatgaaggcaaccttagctctggtataatgatgagatgggaggagatggagaagctcaaaaaatacaaataagagcttagattagtttaatggaagtgtttactagaggaacccattattctaaaagacatgctaaagtaagaaacaaaataattttgtgaccaatatcaaaattaccaaataaacatttactaaatgactagtatatatacccagtgaaaagcattatctatccaactcatcaactcagaaacctggaatgtgttcttcacagttctgttctccccatatatcacaaaatcctttgaatgcaataccaatttttcaagagcggcctagctggtctgtttccctttcttaacaactttcctttcccttctctctgtgacaaacagagggactggcttaaatgaaaatgtgatcatatcactctcttgcataaaatccttcaatggagtcccattgcatctggaatagagcccaagttcttgccatgacctccaagatttgtatgaattagtcccaccttacctccctactctcttctcctagcccctcttctccctatgttgcagctacattaaccttttttcatttactgaaatacactaagctgaagagagaaatgaaggaaaggttaaaaaaattactctcaactttttctagactaaaacactagaagagtgatggttctagcgacagaatgaaaatgctgaaaaagacaaccattctggggatgacagaaagaatacagtttggggcagggtgaacatgagacagaagcaggccacctaagggaagacaccactcagaccaatgctttacaaactgcaggccacagcctgccaatgggccatggaatttacttagtgagacacaaccagcatttgtgcattttaaacagatgactgcatgtcatgtaggctggatgagcattgtttattgaaactattatttcagttatacacacaagcacacattgacatgtcatgacacataatgggtttcttactatgggttgtgatacacagtgaaacagaaatagactactagagggatgtacacagcaggtagtaaaacatgtttgatgaattaacaaatgaatgaggccgggcgcagtggctcatgcctgtaatcccagcactttgggaggccgaggcaggcggatcacgaggtcaggagattgagaccagtctggccaacatgatgaaacgccatctctactaatacaaaaattatccaggtgtggtggcatgtgcctgtaatcccagctactcgggaggctgaggcaggagaatcgcttgaaccagggagtcagaagttgcagtgagccaagatcgagcctctgcactccagcctggcgacaaagtgagactccatctcaaacaataaataaataaataagtaaataaataaataaataaatgaaaaaaggtagctcaagctatggcagtagagataatcattcagaaatcatgcagaatgaaagagggtcccgaggaatgccctccctgaaagagacagaagaggagccaacagagaagaccaatatggaatagtggccaagcaagtagaagctcaaagaaagagctttaacattatggaaagctacaaagacttcaactgtaagatctttaaagcataaattattaaaattatttttagatcacagccccctctgagtatctgaggagaggtacgcatgcactccctgggaaagtgcttgtgccggcaacactctgtacatcgtatcatgaggtccacaggtcctctgcagctttcccagacatgccacagaggtccctggttaataatccctactttacaatacccaccagatttggcaataacaatgcagatggatgtcaggggtgggctggggagacatttatttcaaggagaggtaaggatacagactcacctgcagaaagctgaagaatgacagaagaggaggaaacagagaaggtaagcagagctagccctcagcagaggccagactgaccgtgcaggaagggaacacagtcggaactcgagaggaggtttcaaaggtcaagagtggacgtttgttttaatgagaaagatctcacaccaggaaaatattcacctcaaaacatggtggaggcagtgccttcacaacagacacagtgtgagaaggggatcctagtctgttttgtttcacttaattctctgtcatttgatataacataaagaactacctgtcaaaaatatttcccatcactacttgacaggtaacagctgatttcacagggaaccagctattagggaagacctaataatattgataaaagctccccagaatgatcatcttcaagtacttaaaaaggtttttatttgaggaaattcagccttaccaaagtaaaggaagttgtattagttcagaatttcccagctataatctcctatagtactaccataggtaagacaaaacatgcctgcccagaaacgacctggaagatgatttttaaagttagtattttgtatctaggagttcattttttaaacattttttgttcatctgtattttcaaacttttctaaataaatatacattacttttgtaaattaaagttttttaaatattagtttaatttccaactcaggataactacataccatggaattgacctcctagaacagtcacaccatctattacagattgtgaaagtttctcactgctgggcctaggaaagaaaaggaagaaaataatatatcccatcctgaaactggcagggttgctggttctgcaagcaaatgcaaaaattacatgctacaaatttcaaaatagtaagttcctggtatctgaactgaaagctatgaactctcaagataactggtaaattataagcattttccagtagcctttcacaatctagttctaggaaaaattctggcttttaaatgaatttataaaatagatataaaggacactctaaccacagcatacccaaataccttttcaagttcgactacagcaacatgtctgaactctaagaacagtaacaataaacactgaatatacacagtgtgtataagacagtacttgtattaagctgccaaggatatagaacctgttttccattttgtaaagtcagaacaaattatctatctgaaaataaaacagattacaaaactgccttggccaggcacagtggctcacacctgtaatcccagcactttgggaggccgaggtgggtggatcacaagattgagaccatcctggccaacacggtgaaaccacgtctctactaaaaatacaaaaattagctgggcgtggtggcacacagctgtagtcccagctactcgggaggctgaggcaggagaatcacttgaccctgggagtcagagggtgcaatgagccaagactgtgccactgcactccagcctggtgacagagcgagactccgtatcaaaaaaataaaaaataataaaaaaactgccttgtaggaaaaaacgtttcatcacttacattagttaatagttaagaaccaaatacatgtgggatgactttactgtggtgggataatttacttcagaacataagttactctgctaccatcgtcggtatctggaaaaccctctggtaatacaacagagggtaaaaaaaccagtccaggtattggagattgagtagaaatttccttttgaaataatctcaggttaaaaccagatcttatgcaaaaggaaatgctactgttgcaaagtatacttttcatctaatattttacaaaaagacatttttgttaagaaaggcaaaagctgcaaaacagaactatgtggaaaataatattgtagtttacagtgagctccagcatgggaaaatgatataaatatttgaaacaataataacacagattacaaagtaaatctttaaaaataatgagttcaaatcatgtgttgactctgtagggaaaaaaaaataaacctacagagggggtgggagacatttattgagtgcttctcttgtgtcaggaagtattttacatacattattctgcagcttgggttttggagtagggttttaaaccagagtcagactccaaaccccaagctgcagtagtgacttagctactacatcctactagaaaggccaggcaggtagacatgcaactcagggtagttccactttacttctttccatttgtcttggattaaaactgatacaatcgtttatatcacgttcccaaaggtttttttttttaccagtaactcttatcatcacctggtatctctaccaataactacaaaggcatcttgttgcagattcacagcttctttctcgctgatgtcaataagcactctctgcatatcttgttcctcagcatttgctaaacaggtggcatgttcctcccaggatggtgccaacatttcacccaaaggatcaaccaattttacaccattgtcttccttaaaagaaaaacaaacaataagcaatctgtgcatactcatgaggctgagttgagaacagaactcaaaagctgtttcccttcaaccaaagacagtgatggctgagcagcttcaacaataaacaccaaatattaatactggaccctggattaggtattttatgtatatatattacctcattaaatcctcatgacacacataatcaattaaactaataatcctattttaatttcaatcttcgagaaaactgagcttcagagaggttaggtaatttgcttatgatcatacagctaacaaatgtcagtactgatattaaaacagcaagtctatcttactcgcctaaaaacactatgccacactagcctttgtaaaaggctgtgatctgtgcatccactatccataaactgactagggcacaagtggagcagaataagggcacacagagatccttctcactatgactcggaactccaagaacacactagccagcttgtcaaccagcgggtaggacagacactgaaaactgcctcccaacactgttctgctcaaattcgtggaaagaaagtgtagttcacagtgaatgtcacctgaaagaaaagagaatcattttgagaagtgcctctggaactagcaataaatgtgagggtcttcctagaagtcaatcagtcaatcaattatggtgacttacatatttagacatatacacatttataatgatcacatatttggacaagcaatgcccttgtttgggggaagaggaggttacaatccttcacagacctacaccactttaacttgctgctgatttagctacaaaggcaaaaatcccacagccccagcaatcaaatagaagcatattattcaaaccctgtattaatggcctatagctaataaagaataactacattgtgtcaagaggttggctaagatatagaaacaacaaaagtgctcataaacagataaatggatgaagaaaatgtggtatatatacacaatagaatattattcagccttaaaaaagaaatactgccatttgcatcatggttgaatctggaagacattatgcgaagttaaataagccagacacatgaagacaaatactgcaggctcataacatacatgtgttatgtaaaaaagtgaaactcacagaaacacagagtagtatggtggcggctagagggtaagggaaatggggagatgctggccaatgggcataaacttgcagttataagatgaataagttctggaagactaacgtacagcgtggtgactatagttcataataatatatattgaaaatgtgttgagcgtacgtcttaagtattcccaccacaaaacaaggtaactatgtgagctaatggatatgttaattagcctgatagtggtaatcatttcacaatgtatacatatatcaaaacatggtgttgtatgacttgaattatacaatttttatttatcacttatacctcaataaagctgaaaaaataattgtgtcaaaaagaatactttgattaaaatctaactgtcacaaagactagaactatcaggcgtcatcaatattctgccaaagctcacctgtttgttcattcagaacaagaaattattgccgagctataaaaacctgtctgaaaatgttcaaaatgtttcttttcaaatctttacccttccccacccaaccccaatatctttaatcactgctaagttaacaaaggaaacaattttcaattactgaaaatgtcttaaatcaataaatttggaaggacattgttatttctctaatatggacactccaaaaaatgacagtatcttttcattctttccacacccttaggaatcatgagcttaatgatcatgctcttaaaaaaaaaaagttgtttcacatccaaagcacatataaatgagaaggcacattcctagaattagaatttgtactttaggtcaatttgctcagacactaaggcttggtcttgtaaataatggtctgctttatcagggcactaaacccattacctcaggattgtgggacgctgttaccatgactcctatagtggattttgtctgttttgacctcaggacagctaataatcccatgcgaaacatgacatgatcaagatgttctgccttcgttcgaaatccagcagtcccgtattgaaggatcagtccattgggcttggcgtgtaatgctgagtattttgtaatagcacctaaatccatgtctacaaaattaagaaatattgtttcgggcataacaagtaatttcttaagaaccatttgcttcaaaaactgccaccccaaacgaataggtctgtctcatcctgaacctcctcaaagaaccctatgtttgacagagcaatgggcaggagagtaagtcctgtgggttagaattacctacaagatgttgtccaacttggtatgtccactcctgggcagactcagggcagatagcagattgtccccactctcctcccattttagctccaggactatcctggacgccgggcacacttaaattggtccactctcaactaaaatgaagattttacacctattcagagactccaatgagctcaaagatcatttcattttacaaaaagggaaactaacctaaattaacatagatagctggtgacggattgaggcctaaagtcagattcttgagtggactgaaactacatatccccaaatatctgagaaatctttgtggttcttttgctatttctcccaaactacagagacatattcttaaaggaaaagcaaaaggcaacagtttcttctccaagactacccagatctttttccatttgctaaaaacaatcaggacacccttctaagatgttgctctaaaactagcaatatcttcttctgaaagaatgccacctttttcctttacttttaaaaataaaacatcggccgggagcggtggctcacgccagtaatcttagcactttgagaggccaaggcaggcggatcacctgaggtcaggagtttgaaaccagcctggccaacatggcgaaaccgcctctctattaaaaatacaaaaaaattagtcgggcgtgttagctggcgcctgtaatcccagctactcgggaggcagaggttgcagtgagccgagatcgcgccactgcactccagcctgggtgacaaagggagactcggtctcaaaaaaaaaaaaaaaaaaaaaaaacaggccaggtgaggtggctcaggcctgtaatcccggcattttgggaggccaaggcgggcggatcacgaggtcaggaattcaagaccagcctgaccaacatggtgagacccttgtctctactaaaaatacaaaaagtagcctggcgtggtggtgcgcgcctgtagtcccagctactcaggaggctgacgcaggagaatcgcttgaacccgcgggtggaggtcgcagtgagccgagatcgcgccactgcactccaggctgggcgacagggtgagactccgtctcaaaacaaacaacaacaaaaaatcggcccttagcccactaatactgttttctctgggatactcccattaagtggaacttggggtttccaacctcagtcagtagttttccttcagtagtccatatactacatttcctgggtcaattaattcccaattagcccagagatgaggagcagtccgccagctgctagcctcataattttgttttctttattgtccttcattgcttcaatgaacagaacttgcaagaaatggtgaaaaatacttgcttttgtccagttggaaaaagctggcattcagtaaactaatttagttcaagacagtgatcagatctctttcctaaggatgaatacatatttgtaaaaactgagcagtcagttatgtgtcatgattattcataagagtgtaaaccagtcctgttaactccaaaaagccattaaaaaaaaaaaggtccagataatatgagttcatcctttcatgcgttttaggccctacaactactttcaatgcctctgcgaatgcctttattgaaagcatatttgccaaatccagcgtccacgcaaaaagttaagagtatccccctactctccattcaatcttcaaatctccttggtgcctctctcccgcctaccctcgaatcaccgcacaagggtgattcccggcactccaccctgaggtccccgcctaggtccacgtaccagagccccggcaggagacccgcggcccgtcccgaccagcccgcccgcggggcgcaggggcctgtaggtgtgtcccgcgcgctccgccgctcggtcagtcgcccgccagaccactagcccctccgtcgggccgagaatctgacctgtcccgctcccaccgagcccttgccgaccggtagtctcccttctcaactccgagcctcggggcccggcttacctcggtcaggaagcccccttcacctacacgcagcggagaagcgcccaagcaacaacgtctgcacccaaacccagtcctcagaaccgcagacgtggccctgcgtggcttccggctc

SEQ ID NO: 1905 - DNA, 133833 bp, Homo sapiens
ggggcgggccggggcggggccaggccggctagaggggcgggtctagcggcggcccccggcgaagttcactgcgcttgcgctgacagacgcaagatggcggacagtgcggaactaaaggtaaagcgcagctcgaattcacttctaatattcggccgcggagacggcgccgctgctgccaggggggatgggtccgaccctggggggcctctcgggcctgactccacccgggcctggagttgtagggagagaggcgcgcccggtctcagcagagggggcccgcctgcggcgggccgcgggccccgggtgcctcgggggcgctgacgggtcgtccccggcgtgttattgttgtgggcgcctctggcgggggtggcgggggaagagatagggagtccggaggtaggggctgcagctgtctcatgggctcggctttttcaccttccagttagcctccctgccccccatggggagctggggctgggggcagggtgctctcgtaggggggattgggaaagctccccgtggccgcttcctcttcctcctttgcagtcccgggctcctgtcaggcgctcttctcagacccccgggaacttggcttcggccgccccgcccctccgtggatcccagtagcccccgccccggactcggctttccccggctgctcgcttgtcaggaagcgcctggggtgccccgcttgtgggaagcgcgatcccggggcgatagggtggggatctgggggagaagctctggtaaagtttagcgagccccgggccggcgttggggttcggctgagaggtagtgagcgggacgttactctttctctctgattccgggcagccgaggggagaaaccccctcgaagagtgtgtctttggaagcagtgttgggagggggggatgcagctacctctctcccttcttttgccttagctggtgtggagggtgagaggagcctttgggggtctctgcacacaccatgatggcgatgctgtagctgatggaggtgaatggttcgtgtttatatccccccattgccttttgtttgtagggacatcttgctggccatgttgatttgaacgaaattctcccctcatgctactccaacccccgataaatagaacgttcctcttaacagtaccaattactcacgcctcacgaaattagatgaaagggtgcccccttttccccgcttttctcccaccccaatctttacctgatgatggcttctttaccgtagcagatataccactacacaagcagttgggggagggggtggtggaacccttatgactggattgtgacaaatggggctccgcttgaataattttggtttagtagcaggcagttcttaactaacgcgtattatttcgaggctctgaacgcgatcttctctgtggcttcctgtgtgtgtgaacccagcagctggttatgtctcgacccagagaactgacatctctgtcagagaggagatggggatatacaattgtaaatctttggggagagtcttctttttataataaataaaaattatttaattttttccccgttataatgaaacgacaacttctagaacaaccaaatgccagatttgattctgtagagtttttcctgtggaatatcctcaccgaaagagcttttctcctaataacttcacaatgtttacactccaagattcgtatgttaaggtattggctttgagtgtcattcttttaaaatgtacttctaattacaaatttactgaagggagagcagatttacaatggatggttttgatttttccccagtttcaaactattgactgaaatgagaaagccttaggaatttgaatatttggagataattaacccttgaaataaaaaaaagcacacaactttaagacatgttttctataatttttctcttagagtcactatgttgctgtgatctttgccttgtaatatttattttgttaggagttcttttgaatgatagctaatcagttgttatacatggaccatagaataaagctgaaaagcatgtgcagactatattgtcactcttgatgctgtccaaagaaactagtatggaaagcacatgctgagagatttccttctttgttctttctcattttaagaaagtgcctttggggatagatcagatccctggtgtgagtcttgttaggtaaagtttctctttacgaaaatgaaccagtatcagataaacaccaaacacttgaagaaatgttatttttctaaaattaatctcgttttttgtgctctcccaaatctactagagtttttccagaggaagttttttttttctactcttatgttcctgttgtataatttttcaaattataataactgttttgacatgttggtatgtcattgtgtgtgtctgagactttgaggagctgtgtgataaattgcttagctggtgatagcggcgttaaaaaaatttggttaatactttattgtggttagatttgctgttctttttttgaggggtggaggaggtgatctcaggaacgcctaccatagttatttgagaatgtgttaaaaaaaagagaatgtgtatatataattttctgtgcagtaaggtttggcagatactccttttggaaatgatattttctgaaggctttttgtttgtgattttttggaggtaaatatcatacattcctaatatgataggaaaaatcagagtaagaagaaaaaaatctagattttttgaaattttaaatgggaatagagtacttcaactgtgaagctttacataaaactcagtgacttttcattattttaggtttcagccccatacttcattttgctgtggattgtattcataattattttcctcatggcttttttagtgagtccttttaaatctataagaaatgtgcaaagatcagatgggaaaaacagatagatctttatcccctgtaggaattgtgcaagctgcaacacttcaagatattgccaataaaaattagattgtgagtcatacatatcaaaatgaattctctatgcacatttgtttatgaaaggtttaatttttcattaggggagtacccataaatgtcatttttaagaatgtggagggtattttgtcatctttaggaacttagaagcaggagggtgtgatggccagatgatcttggtagttaataagctgacagcttcatgaaactcctcttaaagtaatttaaaaaaaaatatgtgtttttttggagtaaaactcaaaccaagttatagtgccattttaatttacaggaagaagagtgggagagaagaagtccatcagcattttagtggagtaaataatgaaattaaatgggaagagaaaccataattataaaagttactatgagtgtgtcagtgaattctattgttattttctgcctctttattttcaagaaatagctacttaattttgatccttacgctgtaatttgtctgcttttatttcagatagagtcaagtacatctgatagtttattcatggatttgatttgaatctctataacttgcttttgtcaagtgccacatttagatggcttttgttttatgtcattatttttatcaacagtattttaaaaactctacagtatagtttataaaatactacgtatagtttctaagtatttcatatgattgttttgaaatacctccttcttttcatccaccgttttctcctgggcgatcccattgtctttttcttcaaagagtttcttgtaatccctgttgattgcggtagtgcttagtggcgagtccatagctgattaaccttgggtgtctcctggtgaactccatcagcatgctgctccagggttcttgctgaggcttttgagtttagtgtaatttgtacccttttttgctggtaaccagggataagaaaataaaatggccaatggttgtagcgggaactgggaaaaagtatccaagtctcagaaaaactgggtgtttatgatgagatgtagcctttcaaaacaacaaccaaaaacggattcattacttcatagaattgattgtggtgttttctgaagtgtttgactctggcatgaagcatcttgcttttttaatgtttgaataataatatcttacttatatagtactttgcagttcataatatattgcattatctcttttgatctttccaacagttctttgaggtaggaaaggcaagtaataactaaatcctttttatagatagagaaagtgagcccagaaagggtacgtgactattgcaaggtcatacaaataaaagtggcagggacttgagcctaggtcttgtgtagtcctccttaaaggtcctacagcagacctggagtcctctagggtgcccagttcacagatttctacttatgttgttgctgatactttcccttttggaaaagctctatgctagggtatttttggatattctagggcattttgcaagcttccttgcaaaaagtttggagtttgttagttggaatcatacacattaatttttgtaagtatcattttgcttgagaaaatttcagagaatctgagaagtaagcagaaaaataaacagtacctgtaatcccaacactcagagatatcatggttaacatctgggtatttatccacttaagactttctctctgtgagcatatgtatatgtatattcatcataaaaagatacaacactgttttttatttataatctgctattttcatgtctatccaggttagtaaatacaggtctatatgatcatttgaaaccttacattgtgttttattaaactagtccctgtcagattattctacttttttttttttttttttttttgagacggagtcttcctctgttgcccaggcagtagtgcagtggcgcgatctcggcgcactgcaagctccgcctcccgggttaacaccattctcctgcctcagccttcggtgtagctgggactacaggtgcccgccactacgccccgctaatttttttgtacgtttttagtagagacggcgtttcaccgtgttggtcaggatggtctcgatctcctgaccttgtgatttgcccgtctcggcctcccaaagtgctgagattacaggcgtgagccaccaccgcgccaggcccagattattctcctttttttgcagtgtgtttgcagacatgtaccaaagtttgcagatgttttattttaactaaatatattgatatgacagatcttttttgtgctttagaaagcaatgcaggaccggatgccatggctcacacctgtaataccagcaccttgggaggctgaggtgggcggatcacgaggtcaggagttgaagaccagcctgaccaagatagtgaaaccccgtctctactaaaaatacaaaaaattagctgggcgtggtggtgggcgcctgtaatctcagctactcaggaggctgaggcaggagaatcgcttgaacctgggaggcagaggttgcagcgagattgcgccaccggactccagcctgggctacagtgtgagattccgtctcaaacaaaaaaaaaaaaaaaaaaaaagaaagcaatacaaatgtttattttatttttgtagagtcaggggtctcactgtgttgcccaggctggtctcaaattcctggcctcaaacagtgctgcctcggtttcccaaagtgttgggattacaggtgtgagacactgtgcctctgtgctcggtttttacaggtgtgaggtactgtgccactgcacccactctacaaaattagctaaaatgttgtcagtgaaataaattagtcattcttggtttgttcattgtcatacctttattgtttatgtttctgtaatatgtgagataagattattaaatgatggcagatacaggttttacaaaatgtaagcaaacattacttcagcatcagaatgtttgataaagtatgaaatcgattatgaagtagtattttataatctattcatactattctatgaatagtagaatttcaagtaggcaagtatgtttgattttggaaattatatcacagtgaccacatattgcaagtttttgtaccttatttagatgcttatcagttttttttgttttgctgggattacaggtgtgagccaccacgcccagctgatgcttatcagtttttaactggcattttaaaactatattgaacattgccagacgtggtaatcccagcactttgggagccaaggtggacagatcacgaggtcaggagttcgagaccagcctgaccaacatggtgaaaccctatctctactaaaaatacaaaaattagccgggcgtggtggtgcgcacctgtaatctcagctactcaggaggctgaggcaggagaattgcttgaacctgggaggcggaggttacagagagctgagaccgtgccactgtactccaggctgggcgacagagtgagactccgtctcaaaaacaaacaaacaaaaaatcccccaaaaaacaaacactatactgaacattaatatagagaaaatggaaataagactttaccatatttttaatctcaaaacaaagtgttgccatttaaattgggaggtaacatagtttcaaggatccacaatctctgcctccggggttcaggcaattctcctgcctcagcctcccgagtagctgggattacaggcatgcgccactgcgcccagctaatttttgtatttttagtagagacagggtttcaccatgttggccaggttggtctctatctcttgacctcgtaatctgcccgccttggcctcccaaagttctgggattgtaggcgtgagccaccgtgcctggcccaggatctggttttagaaagataacataggcaatgaaagcatttttatttttagaaaaaacctttatgagttaaaccaattaataaatgcatatgtgaattaagaatgctatttgtgcaacatctgaaaagtagtgcatgtagaaggaacttgaaattgatcgtactctaaatttgattcgttcgactttggtcttcacctaaatctgtatttatgtaacgttttatcattaggatttctttgaaataggcagtagagacaattttaaagtacttagttgtctttaaccatcaatttcagaagtagtattaattgccactgcactttttgctagatgtttatgactatatttccccttccatgttaaaaattgtgcaactcctgttacttttgattccctctactcttggtttcagtagtgtcacatgaaaagaaaattccctagaacccttccttcagagttttctggtaagtcttcattcttagctatgaacttctaaaattcgtcaaaatgaagaaaccacctttttatttttcagcttttctttagatcaagcaaacaaaacaaacataaatcctttgaatattaactaatgatggagatatcagtaactctcataggactgttgtaaacgttcctatttttgaaaacttaatctcttttttaccttttttgctattcactgctttcagtttacccgctttggttgccgggttaatttcaccaaaacactcctttcattctgtcactcctatctataaaaactttgaatggctttctatcgaaaactggataaagacttagttctcagtctagtattcaagattttctattgtctggccccattccactttgtgtgtgtgttttgtctcttcagctgtatagcaaaagcccttaacttaaagccagagctgttagtttgcgtctttttgttggctggtgttctgtttgtacaccccccattctcccatccctaccctgtggacacaataggtgtttttaatatacatgtgtcagatgaacaaattatgtttaagatttgtttctgtcagagactggggcctgatactcttgtctataagacaatctaaattgaaaatatttttagggtcatatcttcgctcttttttcttgctgctgcttagatgaacttgaataacattaaatccagaataatttatcaagggctgttttagatttaccttttacattattttaagttatagagataataagtgactacacttctcattgtaatgatctaacagtaaatagggtaaaaatggaaagacctcatcatcttcattcttagagggaatcattttggtgtatatctgtgtattcttatttgggtgggcagggggaggtgacagctttattgagataaaattaacatatcccattacagttcacctcgttaaagtgcacagtcaggtagtttttggtatattcacaaagttgtgtaaccattaaccacaatcagttctagaatattttttcacctcgaaaagcaaccctacatccttttagcatcatccccttcccaaaccttacctcactcttagccctaggcgactgataatctattttgagtctctgtagacttgcctattttgggcatttaatataaatggaataaaaatatgtcactttttgtgtctggtcttgtattcatttttttctctgcatgggcatttaaatgtgtatgtctgtataatatttttaatttattgtgtgtgtgtatgtctagatgagaacaaaactaggcacatagaaggaacttaagtgaatgtacatgtacataaatatcttttctaaaactgtgagaccataccatatgtagcatcctacagtttgcttttttttacaatagatagtgaagatctttccatgacatgtccagacaatgagatggtctcattctttttaacagtgtgtaatatttcctatgtatgtttatagagatttacctcttgaatttatcagtgtatatggttaaaagttcttaacaacttgttttgatggttttgctatacactactggtttttttaaaaaaataattgccacatttaatgtaacctctgtagtattaatgctggagtttcacttaacaataggaatgaaaacatcacaggtaagggttgtatagcttgaggagaaatggaatgcagggtctttatgcagttctggcagtgctcagccaaagcaattcattttgtatttgggtttctgaatgtgagcaagcctgtttttaaaaaagctcatggcatagtgcttaaaatagaacttaacatgctatcttgtgctttatggtgaattttaagactttttcttgcagtcatgcaagtctaatcttaaagattggaaagatttcagagtaaatattttttctcatatgttaaaatcatcattctggtctatgggcttctgtaagttacccaagaaggggactgaagaggcacagaactggctcagaaactggcttatagtagattctcagtaattgttatttattaaagaattatttatcacattctgttatttattatatttttgggtatctgctgtgtatgaggtaccaggttattggtgattttaatatattatcacatatgtgtgtatatttatttaaatatttctgttatagcggaatgtttactaaaaattatctttttaaaaattatacaagtaatgcatcagttcttacagaggttttcaaagtctatttctcaggcctctggtggttccccgaagtttttctgagggttctccaggtcaaaatgattttcctaataataggcattatttacgtgctgacatttgcaaaatcagtggtgggtaaaactgccagcaccttggcacaaattaaggcattggtactaaattgtactagtagttgtgttcttcatcactgtgcacttggaattaaaaaaaaaaatgccagttaaactttatgtccttgatgaagcaataaaacttactaattttattgtatctcaatccttgagtacatttaaaaatatattttgtatgatgaaatgaaaagtacctgtaaaacacttttattgaatatcaaatctgatggttaactcaaggaaaagaacttgtgcagttgagttgtgagctttttaaatggaataccatttttacttgaaaaaatggctggcaaagtatggttatacagactagggtatttggcatacattttcatgaaaataaacaaagtgtgcctgtcactacagggaaaacaactgacaatatttgttactaatgataaaatttaagctttcaaatgaaaatagaactttggaagacatgtatttgccactgtgagcttgacagtttcccaatacttgacttttttgataagatcagtgtgatattaatgaatgtgttatgttgaagttgcatagtgaaatatgtcaacatttggaagaactgcataactcagtgaactaatattttccaaataaccaatgcatgatattacaaaatcatgcctggataaaaagatccattggaaatggaagatagaccaatgaatttcagtttatcagagtgggaaatattcattgatacggtttcagattcctgcgttgcagcagcctttaagaacctgccatttgttgtgttttggtgaaggatcaaagaatatcgaaagttatctgaaaaggctagagcattttaataaaaatactctattttttcccaactctatagagcttcataaggctagatttcctttatattcttcatccaaaacaatctaatacacagattgaatggaaaagtagatgtgagaatcaagatgtctttattaagctagatgttaaagagatttgcaaaaatgtaaaaccatgatagtcttctaatttttattaaaaatattttttaaatatgagatttatgttaacaagtaatggattaattaattaatttgttttttgagatgggctttgccatgtcgcccaggctggtctcgaagtcgggggctccagtgatcgcctgcctcggcctcccaaagtgttaggattacggcgtgagacaccatgcccagctattatttttttttaaatgacaaatcttttaaagttttctgctttaactgcaaatacagtaaatattgatagatttaatcgacataaagtttttttgcgggggggatggtcctccactttcaagagtcccaagagcaaaaactttgaaaacttgatcttttttaaaatttaaaatttacagtacagcagtgcctaatttaaaatgggacgatccctttcaccttcccactcatggtattttttataacttaaaaggaaaaataaggctgggggcagtggctcacacctgtaattccagtgctttgggggagacctaggcaggcagagtgcttaagctcaggggttccagaccagcctggacaacatggcaaaaccacatctctaccaaaaatacaaaaaattagctgggcatgttgatgcgcacctgtggttccagctgcttgggaggctgaagtggtaggattttttgatcctgggagacagaggtagcagtgaactgagatccactgcactccaactgggtgacagagtgagaccctgtctcgagaaaaaaaaaaaaaaagaaaaaatttatttctagtgatctcttacaaggcagtttgctaagcagagttatttaattaaatcctgcatctctgtaagtaatgctaaacggtagtagcttgcattgcactgaacgaatgtgcttgaagtactttttttttttttttttttttggagacagggtctccctctcttgcccaggctggagtgcagtggtatgatcatggctcactgcagcttcgaactcctgggctcaaatgatccttccacctcagcctcctgagtagctaggacttcaggtgcttgccaccatgctcagctgactaaaagcttttttttttttttttttttttttttttggagatagggtcttgctgtgttgcccaggctgctctcagactcatgtgatcctcatgcctcagcctcctaaaagtgttggaattcaaggtgttgagccactgcacctggcttgaagtacttgtaatcagtaatggtgtgggaaatatataacttaattttttcaaggttatgttttttcttttttcttttttttgagacagagtctcgctctgttgcccaggttggagtgcagtgacatgatctcggctcaccacaacctccgcctcctggattcaagcaattcttctgcttcagcctcccgagtaggatgcgcaccactgtgcccagctaatatttgtgtttttagtagagatgggctttcaccatgttggccaggctggtcttgaactgctgacctcagatcatccacctgcctcagcctcccaaagtgctgggattacaggtgtgagccaccatgcctggcctgattgctttttctgtagtaaaatataagaatcatatgaataaatgaaaaattccctaacttaatattagccaagaacttcctctccagcagagcttagctcttaccaaatatatatgattgatttgcattctacctattttgtttttttcctttcccttttgtgggataaacttgaaacaggacctagaaattgtaagactctgaatgcttttcagtttctttctgcatttctttagagtggtgtgtgaaaaacttcagcctctgttccttaaacatctttccccagggtgtcaaagtaagactggaaaaggaatatttttgtcccagaagttattctaatatgtgatttcaaaatcaggtagcatcttaaaggttaaagacctttaaaaaaaaagtatagtattttgtgtctaattgaatcataatcagggaaaagaacatgaattttagaattgccattagtcttcacctctgaatttagatagtcccaggaatgagattaatggtcttctaagtgtgagtaggtctggtctgtccattttttcccgagaggaattctataatctcttgttgaggctacttacctggctgataatgtttggggaacaaggcaggataaaggtgtcccacttatgagtatgcagactttgcttaatctccacttttagatttgtgcctcacccttgatcttagttccatgctggtctgagtctggagcctctctggttcagttgttccagtaatcctctggcctcttgtgttacgagaggctagtgggcatggtagggaagttgtctcatggatatttagttagaggagacctgagggtgtaaccatcctgtatgttcagattttctaacagcccccttgtaccttgccccctgtgtttttagatatgcttgcctttctttagtattcccctctctaggcatttgtaggttgtagcttcctcttctgatttagttaccactgcattgcctgcttttcatcatcaaaaagtttgttgaaatttctagttggttatttttttttctttttgtccttgtggattaaagatttttctttttttcttccctcactgtcattttgtttctctttatggggggaatatggcagacatttgtatatggtgaattcatatttaactggaggtcattgtaaactttctgtgaagcttataatacaaactatattaatatataataatgattcttaaatagatgcctatgttgaattaagatttatattgagtggtagtagaaatcgtgttattttctaagagaaagctaggttgcttttttaaaaaaaattaaattatatacagcgtagtatgtataaccttatagaaaaatgtgtaacttatagaaaggtagtaaaacaaacatcaagcctaataaatagagcattctaaaaccttgaggccttcctttgtgcaccctcatcctctcttccccatttcttctaggtaacttgtatcaatagtgtattttaaaggtgaaaactaggagtgaaacagtagttttgtatattattatttgtaatgttgtcttaaaaccattgcatctaatattttatatcatagtcttgtaaatttccaaatttactgtagcattcttcaaagaggaggattccgtaggagaaggtggagaggaaagttttggagacctgaaaatatgtatagggtgaacgtggtggttcacatctgtagtcccagcactttgggaggctgaagtgtgcagattgcttgagtgcaggagtttgagaccagcctgggcgatatgacaaaaacctgtgtctacaaaaaaatacaaaaagtagctggctgaggcatgtgcctgtggcccagctacttgggaggctgaggtgggaggatcgcttgagccaggaggttgaggctgtagtgagctgtgatggcgccactgtactccagcctgaaggacagagcatggccaatatatgtgctcatagatttcagtaagtacatctggtgatgtttgtggaagaagggacttaagttaattaccacagtgatttacccggggttaagtctttttttttgagactgagtttgcactcctgtcacccaggttggagtacaatggcgctatctcggctcactgcaacctctgcctcctgggttcaagtgattctccaccctcagcctcccgagtagctgggattacgggtgtctgccaccatgcttggccaatttttgtatttttagtagagaagggattttgccctgttggccaggctggtctcgaactcatgacctcaggtgttccacccacctcagcctcccaaagtgctgggattacaggcatgagccaccgcccctgccctgggttaagtcttgaaaagtgctcaggcttatgtgtcaatgctctcatccacgaagaagttgaatcgtcagagttatgagaaaagtccagctttttggcaagaccattaaagtctgtgttacaccttaaatgtttttgtccttttttttttttttttttttgaggtggagtcttgctctgtcacccaggctggagtgcagtggcacaatattggctcactgcaacctccacctcctgggttcaagccattctcctggctcagctgccccagtagctgggattacaggtgcgcaccaccgtgcccagctaatttttgtatttttagtagagacggggtttcaccatgttggccaggctggtctcgaactccagacgtcgtgatccgcccacctcagcctcccaaagtgctgggattacaggcgtgagccaccgcacccggccttgtccattatttttttggatacatttaaaaaactcttagtaaaacataaaaatagttattcctttactgggcttataataagtattctttgtggctataggtattctctgctaaatcttgcaaacaagcattctcccttacgctcccctcctccttccttttgcccgtttgacctttggtatcacatttacttaaagcaaggttcttatccagtcattctatcaataaaaatgagtgctgatttatatgccaaatcagctgtgttaaatgctcacacatcatttgggaatgaaatagagtttttgcttttgtgaaattacattctaggctgggcacggtggctcatgcctgtaatcccagcactttgggaggctgaggcgggcggatgacaaggtcaggagatcgagaccatcccggctaacacggtgaaaccgcgtctctactaaaaatacaaaaaattagccgggcgtggtggcgcgggagcctgtagtcccagctacttgggaggctgaggcaggagaatggtgtgaacctgggaggcggagcttgcagtgagccgacattgtgccactgcactccagcctgggtgacagagcaagactccgtctcaaaaaaaaaaaaaaaaaaagaaattacattctagtactcctgtaactatatgaaaaatagtttggttctcttgtacctttccatatttgaatttttatagagagcagatgttttaataattaggaagaactttattttgggaaatgttttctggaatatgaattaacaatgttaaatgcattgttaaagtttaatagtcatttgttgtatatatgcttcctaaaggtagtttttggaggaaggagatgtgggaggagcaaggaaaagatatgaaagagttattgtaggaagtttgattgctggctcactggaaagtttagtgagatgcctgtgcccattgagattgacgactgtggatgtaaaataacatccatctgcatgagtgcatgcattcttttctcctacaaagtgggaactagttgaatgtgccaggcatggagggacaatggaattttgcaaagaaatgtttaggggctaatggatagggcatgacaacatcaatgaattagagatctttgtgaattgaattcttgaaatgaagcaagtaagaaaaggaggttgtagttggaaaatgaaatgttcgagttagtgattttgagggtggtgcaggttctgctggaaatgtctaagatgtggcctcggaagtgggtagctgagggtggaaagtaatgatgaggagttaagttggagcctgaatggccaaggcaggtactaaaactttacttcagtgaatgacaggatgacctagaagatggactgtccagtactatggccactagttctgtgtgggtattgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaattttttgaaatagagatgtggcctcactatgttggccaggctggtcttgaactcctgggctcaagtgattgtcctacctcagcctctgaaagcgttgggattacaggcatgagccactgtgcctggcctttttactttttaaaatgtggctagtagcacatttaaaattacgtgtgtgtctcaatatttgcagcttacattgtatttcctttgaacagcacttttctagagatattactgctcataagtagaatgggaattaggtgggaggacaattgtaggggtttgtagaacccagtggcagaatcctttgggagagggagtggacattgaggcttattttcattgagttgctggtgctttctcttctgctgttgtttgttcttggaattaatgaccttcttttcacccccgcccccccgcccctacctcccttccctccatggagtggctaaccccagggagtttgcttcattctttttttttttttttttgacagagtctcactctgtcgcccaggtttaagcaattctctgcttcagcctcctgagtagctgggattacaggtgcatgccaccatgcctggctaattttttgtatttttagtagagacggggtttcaccatgttggccaggctggtcttgaactcctgaccttgtgatccacctgcctcggcctcccaaagtgctgggattacaggcgtgagccactgcgcctggccagcttcattcttttgaggagaaaaataataaacgataatagaaagcagtaccaacaaaacaaataaccatgtaaatctaagtagttaacaatgtattcataagaggaagaggtcacttctggctaagcttatttcagactgggccttagaagagttttggaagttggtggccaggcacagtggctcacacctgtaatcccagcactttgggaggctgacgtggggcggaacacttgagccctggagtttgagaccagcctggccaactctacaaaaaacagaaattagccatggggagtgacgtcaatctgtagtcccagctacttgggaggctgaggtgggagggctgcttgagcctgggaggtcaaggctgcagtgagccatgatcatgctactgcattccaacctgggtgacagagtgagaccctgtctttaaaaaaagaaaattaaaaaaggtgattactgggatattctttgaagcaagggtaacagcatgagcaaaggtaatgaggagagaaaacattgaggtatgtttgcggaacagctactagatccacatgtggatatctgtgtaagagagtaataagagttaatgggaagttggccgggcgcagtggttcatgcctgtaatcccagcgctttgggaggctgagatgggcggatcatgaggtcaggagatcgagaccatcctggctaacatggtgaaaccccgtctctactaaaaatacaaaaaaaattagctgggcgtggtggcgggcacctgtagtcccagctactcgggagtctgaggcaggagaatggcgtgaacccaggaggcggagcttgcagtgagctgaaatcaggccactgcactccagcctgggtgacagagcgagactccatctcaaaaaaaaaaaaaaaaaaaaaaaaaaaaagagttatgggaagttggggccagattgttatgagaattttccacattgaaactatgtatggagtctgaaactatgttgaatgctataaaggaaagggacagaattctgtaagaacattaactaggaaacctgactgagttagtgtactcaaagaagtcttccctatttctgaaccatctgaactacagacttcctccacatccaagtcttttcaaatcttcttaatgttatgccttcctttccttctcagttgttaccgtcactatttcagactcttgtagtgtcaattttgtattcataaaacagcctctaaattggtatcatatcttacatcccttttcaaattatttactcttcaattagatttatttttttatgtccgtttcctccctttaacattttctgcaattgaaaatgtttttacaacttctcattctttgtaggattaagtataaacttcagttttgcccttaaaactaaaaaattattgtttgaacactagttgctgagtttggatgccagtatgctcagtaggcactgggtacatttatataatgtccttatttgtgagaggttatatgtataatttctttttttatttttttgagatggagtcttgctctgtcgcccaggctggagtgcagtggcgcaatctcggcccactgcaacctccgcctcctgggttcatgccattctcctgcctcagcctcctgagtagctgggactacaggtacctgccaccacgcccggctcatttttttgtattttttagtagagacggggtttcactgtattagccaggatggtctcgatctcctgacctcgtgatctacccatctcggcctcccgaagtgctgggattacaggtgtgagccaccgtgcccggcgaggttatatgtgtaatttctaatatatttgcattaccaatatggtttgtaataattgacaggtgccaaaccgttgttactcatatttattaatgatgaacaagacagtctctatagacagagcatgtattttggttaagaattgacaagtaaacagggcctctctacatatggcataagagcggtaaactgagttaaacaggagagcacataaaagcgtaaatttttttaatgttaggagtggattaaggaaaatatcccaaaggttgtgacatcaaaattgagaacttactgatttggagttagctagtaaaaggctgggataggaggggggagaagagcttctccttgaaagaacagcatatataaaagtcctggaagatggagagttggttaaaagattggttacggtggtcatgctaaggagatggggcctctgagtgcagtaggtgatcatggaaaagtttaagcacaagcgtgacatcattggatttatattttagaatgatcactggcaatagtgaggagaatgacttggagaggataatattggaggcagggagaaaagttaagagtctcttgcagactctgaattagagtggtaatagggactaagatattttaaggtgttaagattgacaggacttggtaaatagattggaggtgaacaagaagatggtgtagcagcttctggcattgacgggtgattaggtggatggaaggtttggagagagttgatgtgttagattcgaatatgttgagttgatgactcttgggatataaggagaggtgtttagcagatgtggatttggagtttaggagaccaaggttaggctggaaataaagatttggaaattgttaatttagagatagcgttttgaagttacgagtggatgagatcactcaggaagactgagctgagtgaaaggattactttagacttaggattcagtgatattgttcttcttctgtcatagagtttatctctacttttttttccttttttaaaaattaaatttaaaaaaattttatttttagacagggtcatgctcttccgcccaggctggaggcttgatctgctgggctcaagccatcctcccacctcagcctcctgagtagcctcccaaaatgctgggattacaggaagtaaaataacttttatttttaaacttttaagaacattggctgcattgagtatttggagaagtactctggaatttgattagctatatgttcaaggaatggtattaagaatgagttttcagtaattgttctttttgactgattatgataaacctcatattttatttcactttctaatgtccacaaaagataaaagactttttttataaaaccataaccacagatcatttcttcttttggctagtttatgaattgtcctttagacatggacaattaaactttttttttctttttgacagagtaagttgtagatagataaactttgtttttctctttttgtgcttttaaaaaaattgcttcttatctggaactttagcattcctttttttttttctttttgcttttttgtttaatgttttggatatgttaaaatggatgctaaaaagtatagtctgtttgggtttttagcctcagagttttgtgagtagctcattttccttttccataaatttcacgaagaatgtgtaatatgttttcatgagcctcaccttgaaaatgaatttttatgtacattaatggaatttttgaaagaaaataaaaacattttctttctttctttcttttttttttttttttttttttttttgaggcggagtctctcttttgcccaggctggagcgaagtggcgtgatcttggctcactgcaacctccgcccccccaggttcaagcaattctcctgcctcagcctcctgagtagctggaattacaggcacccaccaccacacctggctaatttttgtatttttagtagagatggagtttcaccatgctggccaggctggtctcgaactcctgatctcaggtgatccgcccacctcggcctcccaaagtgctgggattacaggcgtgagccactgtgcccagccaaaacattttcttaaacttgcttttgctactgtagtaactttgtaaattttactttaaatcataaaacttaaattttaatcataataatctgttctgaagataatgatcataatgatctgtaagttttgtggaaagttagcagttttactttacatagactaaaggatgcttttgttgtgaaattatttctcttatctgtaactagtagaatattcaagtgaaagtcttccattctgtgtagaaaagaaagggtcgttattattaataggcttctgatggaattttaaaaaatatttaggcaagctgtcattgcaagacctgaataactttttgctgtaacctatttttttctttttaatatttctctgtgtagtttgtaaggaatcattcctagggcttttttttttttttttaagatggagttttactctgctgcgcaggctggagtgcaatgatgcgatcttggctcactacaacctcggccccccggggttcaagtgctattcctgcctcagcctctcaagtagctgggattacaggtgcccaggaccgtgcctggttcatttttatgtttttagtggagatggggttttaccatgttggccggtctggtcttgaactcctgacctcaggtgatctgcccgctgccgcctccccaaagtgttgagattacaggcgtgagccaccgctcctggccacctagggcttttagaacatttgtgtacgtctttttaaaaacttgtttctgtctaaaacttataaatcaggactgaaatatgataaccttaattttcttgtgcactctggaagatgtttatttttaccttaagataggggaatcaggctgggcgcggtggctcacgaatgtaatcctatcactttgggaggccgaggtgggtggatcatgtcaggagattgagaccatcctggctgacacggtgaaagcgcgtctttactaaaaatataaaagattagccaggcatggtggcatgcacctgtagtcccagctactcgggaggctgaggcaggagaatcacttgaacccaggaggcacaggttgccaagactgcgccactgcactccagcctgggcgacagagtgagactctgtctcaaaaaaagaaagaacaacaacaaaaaagattggggaatcctaggagaaaagagtcatcttaatcgcaaatagttgaataatcttcatttgtagccttaaattttattgttacttggaggataatctcttatgatatgctcagggccctagagagttgacactgtcatattccaagttcttaaggatgacttgggtgaatatttaagggcacaattctcagattttatatatgacacggaactggaaagggtgtgttaagattataaaaggaagaggaattcatatcatcatctgttgggcacttacttggtgtcattaactatacttgcataggggatatggagatgagtgtttacccttgaaaaactcaaaatctatgggaggacataaactggaaaatcagtgttttaccacatttcgtgataattgtacaatagaggggtgtaggatacaatttttcaaaaggggtttgaaaggctggaatgaagagctgaaaaacatgaagtttaatggcatgaaacattacgttctacttttaaattaaaaaaattgtattcgaggatgaggtggtttgactttatactgtagccatttatgtgaaaaagatagaataaaggttttagttaacataagcaacaggatgatgtggatgcagccccctccctgctgaaataaaagaataacacataccatacatcccctcttgtccaaataaaacaaacctaaaacgtgaatgacttgttaggttatattggtaaaaataccatgttcatattaagagggatagtaatactgctgtgttggagactagtcacaccatatctagattatttcattcacttctgagtactatggactgcagaatgcttgagaatgatcaggagtgggaaggggtctagctagttgaaggaaaagagtccttttaacacattttaagcattttaagagtcaattttggtataccaagaggacgaaattttagagccattgggcggactttaaagggaactttcaattcctagagcttttcgctaatgtgggcagcttttaaaggttgtgaactcttagaagtgttttagcagaggctgggggcccagtcaagaaagttggagtaaaacttcatatattagatggagttttagacaagaagatctttaagttctgtttttgatactctgttgctgttatttccaaaaacattttcatactatgtgatagtgtctgtagttgttattaccatgtagcattgtgtggacattggcatttgccttttgagtctgagctccactacttgctagctctgttaccttcagtaggttactcctgttactcggaaatagttcagtaccacccctctaggacttttccttaatctctatactaggacccagactgaaggctgtaatttagactctttagtttagaagatgcattcttgtcactttttgttttgttaatacgtgtttcttcttttaggcttttcagctttctctcagatagggtatactgttcattgtctcttgtcttatctgaaacttagatcatctaattgcaaatgcagtgttttgtttgtttttggtaaggggacagttaggaaagaataatcatcttttagaatttaatagacttaaaacttcttaaagccctacttagtatttttaaattctagattttatttgaaaagtgaatgatgattgttctcatgatcaagtacagtactaatttttaaaagacctacctgtttgtagaatattgaacatggcctgtagtttttctttgcagtatttcttggtcctgtctcctgtatttccactgcacagttccttcttaccttacatgtagataaatcctgcgtgttgccatgtcttttagccagaaggtttatttcttagtttttttcttatttcagccatcctattggtggttacttcggtaacttccttaagcactatttcaattacatctttactgcctctaaaatatgcatttattccactgcctgctcatgttatactgtataaattccttgactgtcatttagtgcccccgtcacccatttcctgtccgtgtctcagtgtaacatatactcagctctggctgagcttgtgataagacattgtattagttatgaactctggaatcaggtcagatttgagccctatctccatcatgtagttactgtgtgattttagatgtaatgtcagttttcttatctatacagtgagaataataatgctctgtcttgtaggttcatatgaggattaaataagataatcatgcttactataattagtatgttactggtacattataagtatttaatacatattatgttttgtcatttttagtctgtcaacccatgtaaatgacgctaaaaattatgattgaaaacatttttaatatagaaagatttcactaactgtatgtattgtatttccccaactgtagaagagtagaagaatgagaagaaaatttcatttaatacagttacaatgttgaattttgaaattttaaggaatctttgagaacctctagttaatccctctttttttttttttttcaaagtgagaaaacagaacctgtaagattgtaatttggtaaattagtggccaagtcagtaccagaatccaaattctgtatttgccagtaccattatattgtattgcacatttattcagcatattttaggtattcagtaacttttgagaattgaattaatacgatgattacgcatgtttctgaagactagtttatttctatgtgttcattgttcctgtcttctcttcctatacatactcatttagggcctgtgcattgatccaaaaagcatttattgaacatctgtgtgcagagcagcctttttcttaaataagagccatattttcccacctctgcataagaagtctggcaatgtgttagaaatttgcactctaaattttaaaattaaactaagccctttaaaattttttttccttttttctttttgagacagtgtctcactctgttgcctagactggagtccagtggtgtgatcacagcttaccacagcctcgaactcctgggctcaagggatcctcctgcttcagtctcctgagttcctgggtctgtaggtgtgtgccaccaatgggcctggctaattattttttattttttatttttagtagagatgaggtattgctgtattgcccaggctggtctcaaactcctgggctcaagtgttcctcctgcctcagcctcccacagtgctgggattacaggtgtgagccaccacacctggcctaaactttttaggaaaaatattgtactccaatgttataacattctgagttggatttgttatttatttttttgagacagagtttcgctgttgttgcccaggctggagtacaatggtgcgatctcagctccctgcaaccttcacctcctgggctcaagcgattctcctgcctcagcctcccgagtagctaggattacaggcatgcaccaccatgcccggctaattttgtatttttggtagagatggggtttcaccatgttggtcaggctggtctcaaactcctgacctcaagtggtctgcctgtctcagcctcctaaagtgctgggattacaggcctgagccactgcgcctggctggatttgttatttttaatgttcaggttatcgtccagaaggagctttttgaaggatagaagtttcatgaaatgtggtagtatataaataaggatgatgtttaaattatctatcaaaaattaaagccatggtgtaccatttcaacagtgtttatactttgtttaaagaagaatgggatctctatttatgtataattgcaatattttgtcattttgtgggacctcaatgcagtcaataagatggacctggagaggtggaagataattaactagaggagtaggcactacaggtcattttccggttgtcttatgctgcaaaatagataaaagttgagaaattgggtgaaacaagattatggagaagtatgtaaccaacctgatttgctgctttgaatagaaactgtctaactaggttttctggttgaatggggcattgttgacagattgctaatagctgcttattaacaatttgtaatgagaagatttagaaatcatccaaaagtaagccccattgaatgaagaatctgactttgaaaataataaaatacttttgttgttgtgtgcaagctttaatgtgtgcagttacagaatttgtgattatgcatttgcttttgtggatgaaaggcaaaagtataaatgaaatattatgacattattaaatccctattttgtctgtctttggaattcattctggtttacaattcgttataaattgataccagataaagactcataatatagtctgcttaatgactaatcctgtaaaccactgcagtgggatgtgtgaacaagagtaattatgttgttcaacaagaagtacctaattcttatccacagtgtagatataaccttcaataatggaaggtcacagctaatgagacaataaaactggcactttctgtttagttgcaaaagcctgtttgcttgttgacgttgtttgagtattgtctgtatttatctttctcagaacatggcccctgcctctgtgtagttgggacagagtttgcgtacatatatatctgtgtttttgtaaagttttacatatctgaaaaggggattgaataaaatgttattgtcttgaatgtattgaacctcccattctgcactactctgcccttagaacactagaagccagccttataccaccaaagcaggagattgggttgttcctctctgtcaaaagtgatcagacaaaaggaagcaaagggaatccaaacaaaatagccaggttattgcccagtcattctagatgaagtaccctggtctgctcactcacatagattttcccatcatctttttagtatcttactcttaactatgtatgcacagcccaggattgtctctcatttaaggaaagcttcaggcatgaaaggcagataccagtgtagggagaagaagaaaacaacatcaacacccaatttatattctcaaaaaagaaaaataacaaaatgtagaggaaaaagaaaagagaaatgcagaaaattaaaagagttcatggaaattaaaaatttaatgtaagcgttaggagataaaattgaggaaaatcccagaagatagagctaaaagacaagagatgtaaaaatgcacaaggaaaaagaaaatagagtaaaggaaaaatgagattatcagtctaggaagacctgtgtctgaataataagtgtataagaaagagaacacaaagacatggaaggaagattattgtaagaaaacttcccagaactgaaggggacatacatctctaagtttaaaaggatcgacagttatcagtttatgcaattaaaaaaaaaaaagaccaaccccaaggcacaacattgtaaaatttcagaacagattaagagaagctgctatgattccagatggggatatatagttgactatgaaggattatgggtcagattggtactaggcttcttaacactggaagccagaaaacaataaggaaaggccttcaaaatcttgacacaacatgatttcctgcccagcactctgtactgagccaaactcagtcgtaagggtaaatgaagattttaaaaatacaatgcaaggaataaaaacatcgtacctcacatgccccctttctcagaaagctgctagaggaaataccccactaaaaagagaaaaccaagaaaggggaagtagtggcataaggaaacgggatccagtataaaagagagacaagggaattcctgggataagctaaagggaaattccatgaccataattgtgcaccaggcttggagagcctacagtccaaattggaatatggtggagggctacaggaaagaaaactgatttacctgatgtatttgaatatattgagaagaaagttaatacttttagctgtttgcagatgaattagcagtaggtacctagaaacctaagcaaatggaaaaatggtgtagttattaactgtaaggaaagcaaagttatacagaaaagagtaatcatgatgtacttttggctcagctgtgaatattatttacagccatagtaataatgtaagtactgacaattgattcaaccaaaaattatgatagaaagatgagggagagaagatgtaacagagctaaaccattatattttataataggaagtcagtagagtcctcaaagaaaaaattaaacagctgcatagacctactacatagaatatagagaaaaaaatgccagaagaactagctaaaaagacttgaaagtggttgcctcggggatttgaaaattgtggggtatgttaaagggggaagggactgctgtttttcttgtaaaactttttggttttttaaattgtgttcacgtctgtcagattatgaaaattagttttaagaggttgctccttacagaatgctcttgcattcaaaatatatacagttctgaggcattctaaatcccctaggattctgagatctctatcaattgaggacgtagagtcagcagaatgctacaaaattgctgaggaagtaatgatttctaatagtagtagtggttgatgcaatccttagttgtaaatatttattttgttgtgctaacaaatggagatttttaaacaccttaaatgcagattaaaatatatttcatttcaacaactcagatgtgttagtgtttagttttcctcagtgttgtcaacacttttcattgtgaattgactgctttatgcttctttgcagcttttctgttgaaagatgcttcagtgtttcccgcccccttcttttatttcattttaaaaaatactgcatgcttatcacagtccttaagagtatgcaacagctgttccaataatagcaatagatagcacctgatttttcattatacctgattataagttgcaatggttaatttgaatccacattcttttcttatcttaatcgccagtttttaaaagccaaaatgttgaagcttgaaatggagattgagttaaataaattaatcttcaaataggtttttctgttatccaattaaaggcatgtggttcgtttcctcttaatgtcaacatattatagcatgaaagaaagtacatttggagtagaaccagttgcatgacattcaacacgtttcttaaccttgctaagtcttattttcccacctgaaaagtgagaacagtacctgcctgataattatgacaattgatgatgaatcctgtaaaaaaaaaaaaaaacacccagttactcaggaggccgaggcaggatcacttgagcctaggtgtttgagaacagtctgggcaacatagcaagaccctatctcttaaataacaaacaaaactaaaaagcttggcttgctgatagcagctactatttgagtacctactatgtaccaagtattgttattgctgctgctactctttgtttcagagagagacaaaaaatgtaattgagggcgctcaagtttattgttgtgtcataaacttttttggaccatcaagcaagagattttatgagaaatgtcaacatattcttctacaaaaataggaaaatgatacatctgcattgcatctgaatctttgtacctatggaataaagacaaaagctgtcatcaatgcagagtttacagtagtcactgaattttgctggtttgtttttgatttaggagaatggagttgaaatagttctcttcaaaatttgtactttttttttctgtaaaatgcagtacatttgacccatgccaacttaaatttatttttaacctctaatccttgaagtttcatgttatttatttaaaagcagtttacttattaatagtacatttcagtttgaagtccctgttcctttttaaataataaaagtctttagaagtattttgtactcttttggtgagtagggagaaattgatatcctgctgatattatagttagtaattgtttacaatctttgataacattaaaaagagaaaacatttctaagatttgggtggaatttgttaaggtttacgttatatctttgcatgcctctacagaacatgaatttgagcatttatttggataagttatcgctgtagatgctacctcccaccctttcttctggtgtcctttcttacttgtttatttgttcgttcattcattcactcattgattatgcaggcatttgaagagtttccactgttgtcaggccctagttgtagatgctgagggtaatatggttgtgtaccatggagaaccctggtttgcttatagaatcacttgtgtaaacagaaaattacaataaagcaaaataaatgctaaaatacagatgcgaaaagtggcctttgtaaaaatagtgagagtaaagatcatcctaccaaggctaatggccaaaggctaacaaaagctggaccttgaggaaagagttttccaagccagagaagtaaaggaaggactcatatttctttgattaaccagctatattgcttataaagctctttatatacttttctcctcagtattttattttttgcttaatggttttgccacctgcaaagaacccttagagaattggctggggttatcattgtgagtggtggtgagttagggaaggcagcataagcatagcttttgtgtatttggtatgaggtgaaggaattagttggagaaatagagagcaaatggtaagcttacatgtgtctttttatcctaatactccctgtcagtggtgatgcaatcttttaggattctgctaatagctgtgtgatcttgggtaagtgatttcttctctttggattccattttccaccactttaaaatgggaggattggtatagatggtcatttcctattagtaggtggggaaaaaggagaaagggggactaaataagtttgcgaacataggtaaacaaagttaaatagattactgcagcctcatgcattatggcatatgaattgggttgctggacttctagcttggccttgcaagttaagtgagagtcagtaatatgagtccagctctgtctttttcctaatggtttagtggaaagagcatgggctttagaatcagacatatctgggtttgaatcctgactactccttagtagctttatggctttataagttatctaacctttctgaacttgtctcctcatgtataaatcaggcaggataataccttgcggagttgtaaagataatgacattccatgtgaaaatatcaaatagaatatctgatatataattggtcaaaaaaggtgtaacttaagtctacaaattccagagttagtacagaatgtaagtaacacttgataatagctattgatatcctgcctacatctggtgtttgagatggactgtttgttgtttcatatatacttataattcttccccaagaaaacaaaatattcttgagagcacatcattacgttttgccatctacatagcactcgacattctcctggagactcagtaagtgcttgataaatacctgacagtttcatcaaaacagtggaataaagtgaggtgtggttttccctggtgtatactttatcctatatttcttataaccaagggtagaagtcaatgaatttatgaatattaattttaaatttctttggttacttaacgttaaatgattaaatttgaagtttgaaataataggattataagtgagctggcctttatttgcttaagtaaaccataagaagggggttataataaagtgtcatttaatagtgtaaattatattattggaatactaatgttttacattttgttttttctctaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctaggtaagattattgtatgatagtatttggttacttttgcaggatgaattttcgttttaggcttttactttgacccagtttattattcataatgaaattttcatttgatagtaacagctggataataatgaagatctttcaaatttagataaaatcaaatatataaaagctgtctttcaggaaaaaaggtagtatagtgatggttactgacaaagtaaatattaaaaagtttcaagaatataaacttccaaagagtagtattttagaaggttgattaatattttataatatctcataaattaaattaaaaccaaatgaatcactacaagtctctgattagttcttaattttcaggggttgatgatctctaaaacaaatcactgactagttttgattatttaaatgagtgaatggttttaatgatcataaaaggagacttgagctttgatgtatgctagttaaatttcagctgatttttttcaagtggagaagtgcatgctttacaggcatgcacatgcacatgcacactcatgattacggttatataatataagtgcttgaaatttattttactgtgttgttccatcatttgatttgtagtctagcatatagaattcaatatattaatcaacttgtaattttaattgctataatgctaccttatttatttaacgtagaataaaactcaactgttgtgacctctgatgcctttggtataatatatttaaaatatcagacttctaaatgctggtttgttggcatactacggctggcaagctaagtccagtctgtggcctgtttttatgtggttctgagctaagaaatctgaaaaatattcccaaagagttattaacaaaaaaggaaagaaacaaaaacaaagaatgtgtaacggagaccatgtgtgcctgtaaagcacaaaatatttacccgtatagtaaaagcttgtgaatccctgttacagatcattgaacatttcagtttgggggactggcaagtgttgagaacattttttgcgaatttttgagaacattttgaaaatgtttactgaaattctatctttgaaatatgaagtgtttgtttttaattatatttagcagaaattatctgaatacacgaagattataggagtcattttcaaacaacgtgagttttgtatcacattattttattttttaagtggccataataagaaaacattttttgagaatctactgtatgcttataaaactgacacatgctcattgtaaaaaatggaattgccaaagttccttccttgttagctgtttagtgtgtatgcatatatagtataagcaaattgtttcttgttttttacagaaggaatcatatacatagtattgtataacttcccttttttccccttaataatatatcatatgcatcttttcttgtctgtctgattatgtgtgtgtatatatatatatatatatatatatcccattttaaattaaaggccatatctgtatctatccatatctctgtatatggtctgtgtacatgtatgtatgtgtacatatgtgttatgtattgatcagttgatgaaaacgttgtgaccaggggcttgcaggaacctaaccctatacttcccctggtagcagtgattatatattcgcaaattcagtgtttgtggtgattttatgaacataaatgtcacaaatagcaataattgactatatttgaagtatgatttgaatgccagttttcatgaataaatctgctgtttgtggtatgtattcacagaaagtcaccaaatgaataggtggtatagaattgcttagtgatatgtaaatagattttcagtatctcatcgttatagaattaaaaacaaaccaatttaatatgcataaaaagatctcaccacaaagtaatttgtggaagtttattggctcaataaatatttgttgaagggcaatgcttattgaatgtgaaaaatatttattgaaaaaagattttatgtaattagtcttcagggtgtaggatgagtatattttaaggctctgtttttataaattctttaacattattaagactttttctgtacttcattaaatgaagtggctacatttgtcacataacttagtttcctaaatgattatttttgccggtagttcatttgttttaaatctaagaaaaccacgttttctggaaaattaaatagcttccagcattctcttcatttctaaacgtacatacatttaaaatcaagtttttgagaacatagtttcgaacaccagctggctagttgatcacaactatcactgagtccagaatgggacaggcacatttactttttcattttttcccttccattgtggccttaagcactagatttaaacagattttaagatgttcaaatgtaaactgaatgtttttatgcatggttttgtatttctaactaaaatggaagacagtagttctgataattcccattttattaggtaattctcattcattcttacgatcattttgttatttctttaaaacaatttaaaataattttaaggcctttattttggagccataattaaagtattcttttcattgtccataattaactgtaagaattgagaggtgaagtaaaaggtggttgtaaagtaagatgtttaatttattgtttactttggcctctcattatctcaattctgtttgtttctatgaggcttatttcaaatgctttttttctttaacctttttcatttatctttctaggctgtcctcctttcatctgtacatttcttccccagccagaatcaatttcactttccctgcatgctctcataacatttattttttatttttatttttttgagacagagccccattctgtagcccaggctggagtgcagtggcacaatctaggctcactgcaacctccgccccactgggttcaagtgattttcatgcttcatcctcccaagtggctgagacttacaggcacgtgccaccatgcccgactaattttgtatttttagtagagatagggtttcaccatgttggccagggtggtcttgagctcctgacctcagttgatccgcccacctcggcctcccaaagtgctgggattacaggtgtgagccactgcacccggcctcataacatttattttttaaattttattttattttattatttgagacagggtcttgctctgttgcccaggctggagtgcactggcacaatctcagctcactgcaacctctgtctttccggctgaagcagttctgccacctcagcctccccagtagctcagactacagacacgtgccaccatgactggctaattttagtatttttagtagagtcagggtctcatcatgtcagccaggctggtctcgaactcctggactcaagtgatcttcccaccttggcctcccaaagtgctaggattacaggcgtcagccaccacacccaacttaaattgtatttaataataataataattattattattttttgagacagggtttcgctctgtcatccaggctggaatgtggcggcgagatcttggtttgctgtggccttaacctccctggctcatgcaattttcccaactcagcctcccaagtagttgagaccacaggcatgcaccaccacacctggctgatttttgtttttatgttttgtagagttgaggtctcattatgttgcccaggctgtcctaacatttaatttaccctttattaaatgtttttgttttgttcctcaaaatgataaggcttctgaggcatttatctataaatccctataatagctagatatgaacctgttacatggtagttcagtaaacatttattagctctccaactcgttttaatgcagtagatggaatcttttatttcattttaattcagtggattttaaccattttaccttgcaaacacaactgagccataccacactctgtaattacaaacagtggctatgatagggatgggaaatagagtagggaagaatggtattcttcctcttattgccctatcctgtcatctctgaggttaattgatgtctttgaaatttaatatactccatttaaaaaaaattttccctaattacaaaaatgttatgtttaatgtagaatccatagaaattataattacttgcttactttacagataaacttttaaaatacttctgtggtattctttttgttagtcatttacgggtgtgtgtgtgtgtgtgtgtgtgtgtgtgtgtgtgtatttctggtttcattttgaaggagaggagaacctcactagctcacgtaacctggcagccgcatgtattattgatccatataaataatggaagaaaattttaatcttgataggatgttgagcacatgtgttaaggggtactttgtttgaaataccttattgcttagtgtgccaatattggtgttgatgaggtgtgaaatttacataattatgaaaataaaaggaaaaataattttggattaaaatatcttgtccattcagggacaagataattatttgatatttcctctcaatcctttaatattgttttgtttagaataatacctgtatcattcaaaatagtttataatattgtttatagttattgtttaaattggctttgttagaacataatggcaaaaacacagaatactttcatggtaaataaaataatagttctttaggatacagtatttgatttgattcagacttaagtataaacaaatctattaatagatttatatttgttactagtttagctatttatatcttccttgactcaggtaaattttcaaatagaaaatacatttttaatatagtgcttttaaatatttttaatatttttaattatttcaaaggccaacatgtatagaacagagagctttgcattcatttggactacagatactcctctggttatgtcccaataaatccatcataaattgaaaatatccaaagtcagaaatgcacttaatacacttaacctaccaaacatgataggttagcttaacctaccttaaatgtgtctaaaacacttacattagctgacataacatctaacacaagtcctgttttataattaagtattgaatagctcatgtaatttattgaatatcgtactgaagtgaaaaacagaatggttttgttaccaacagaatggttgtgtaggtactcgaagtaatttctactgaatacctattgttttcttaccaccatgaagttggaaaattgttaagtcgagccatctgtagtcatataaaagtatggtgactcatcttgtttgctttatatgagattgaagtcaaattttaccttctcaggggatgtcttttcaagtttttaaatatctcaggcaatatatctgaataagttcacatcatatgtctttattgattagagatttctcattgattggtatgaggcataataattattgactatgagtgttacttattttttttctttttttttccgagatggtctcgctgtattgcccaggctggagtgcagtggcacattcttggctcactgcaacctccgcttcctggctcaagcgatcctcccacctcgcctcctgagtagctgggacgacaggcaggagcaaccatgcctggctcatttttgcattttttgtagagacggagttttgtcatgttggccaggcttgtcttgaacttctgatctcaaagcagtccgctcacctcagcctctcaaagtgctaggattacaggtgtgagccaccgcacccagctgactatgagtgttatttctaatgttctaattcaatgttcttctacttgattactgaaggatagaatatctccttgctgtggtctgaatgtgtccctcacaaattcaaatgttgaaacctaattcccaatgcaatagtgttaagaggtggggcctttagcaggtgattaggtaatgagggcgtggcccttatggatgagattaatgcctcttataaaagaggctccaaggagcttgtttgccccctttcatttgccccctttcaccctgtgaggacacagctaaaaggtgctgtctatgaggaataggcctcaccagacacaaaatctgcagatgccttgatcttggacttcccagcttccagaactgtgagaaataaatttctgttgtttataaattatccagtctgaggtattttgttatagctgcccaaatggattaagatactccttttagccaatctagttgaaaccagtagtgaattgataaaaagtgatacataagttaaacatcttactttaatgtatatttatttgccaatcttttgatgttggtcaaggccttttctttgacagtgatgacttcgcagttttagattattttagcaagaagacttaaaggcttttatgaagatatttgagtatagaatctgttgcgaatggggaaaaatcttttatagttggcttcattggcattttttaaatagcaacttggctttatcaggtctttcccagagcatttaacttagttttcatgaaaacagcaactttctttttagacttacattttagcagcttttgtaatatttaattcagttttgtaattacaattacaagtgcaactaacataagcaagtttgagaataaacctctggttcttggtaagcataccacatggtgtgagcagaattgtgcggaagcactgtagagttgtctactggccacaggcagttagcttggtagggcattggtctggatgttctataaagggaatggagagcatcagttaatcataatatcagttaagagggcttctactgaatttcttttgcgccattcttcttaaactccccaaaggcattgaaattagaagttcattttcttgcctgagaataatttaagtggtttattttgtgggggaacaacatggatcataattgtggttgagttttaaaagaaatcatttagctccctttacccctttgagagggttataatggggggaaggattgggaaaagtagagaagcaaattatgttttttatcatacagttgtatgttttcttttctcatcaagcacagtgacagtaaataatgagtataaaaatgaaataatttcctagtcattttttcttgtctgttttttcaccaaaaattatttaaaattttgaaattatctgtaaagatcactgccttttcttggtcctcctaaattctgaaagtattctaatattgtttagaaagtgtttggacgctacagactgaagaatctgaaacattgagaaacacttaaattgaccacatgggtgtccttcaatttgtgattaaacaaactgtgttttatttttttcatttttaagcctgggaaggtggcttctatttaaattttgatgtttatgaaacaatcttttccattaaacaccaagaatgtctattttctgggctatatatatatttgaattttcctgtgcttttttaaaggtacagttgttcttacttgacatgggatagtataccaataattctggagaagaccggcaacctagatgtgctgggcgtatagtcttagtatttaagaaaactagattgaccctttttcctatttaaagtagaatatttctttggagatatttacacctcttttaggcttgagaagatgtagaaataatttatagaaaatatttgaaatatatatatatttatataaacttgggttttgctctaggcaaaaagggaacagatgctttaacactcctaaatagttaaaatgatccatcaggttttgtgcagtgtgggtaaggtttctgctacatcttaataacattggttaccagtgttttctgccaagggctcctctgacattggattatatttcacagttttcttcttttctcattttttataattgagttttcctttttccacattcttaatatccagtgcctggagatcaggtgatacaaattcaaggacgcaggctctgataactattagaaagggcattcaaaggttttatgattcattctactctacttttagataattcagcataaactgtgctcctctatacttgaattttgggaaatcaagagcactaatttttctgtaggtgggtttctttggaaatttttctccctaattggcagcactggtttctgaccttcaaaatgaagtctaacacttacctgctaagtcgtacattcctttatagataatattctgtctttttatctggtgattttaatgtaatagtcgtgtttgtatagttgtccagaattccccaaggcatccagtatttttgataaatggatgtctgtgtacttgagtgtgatcttgggaactaagaatgattggcttttttgggtttggaaaggaatcttaaccattagaatcagtgaaagaaccactctatacaattataattatgaaataattttttttaattgagagattaaggagccaaacacttagggtcagaagtaagtacagtttatcaaagaaatccaacatttaagatcttactgggatcgaatttaaagatcagacatctagtataatactgtatagtgtttgaaatgcagcatttcagaatttaacagcgaattctgccgtgcttcgctcagcctcctgtgcacaaattgggttgccatgagtttgcatggcagccagctggaggacttggttgtggtaatcatggggcatgtggtcatcatggggtagataggataatgtaacaaaagggagaatctaattttggcgatcatttctttctttcttttaaaaaaaagacgttttgttgacacatagctgggtgtttggaaaataattttaagacattcttttttttttttttttttctggagatggagtctcgctctgtcacccaggttggagtgcagtggcatgatctcggctcactgcaacttctgcctcccgggttcaagcaattctcctgcctcagcctcccaagtagctgggactacaggtgcccactgccacgcctggctcattttttgtattttcgtagagacagggtttcatcatgttgcccaggctggtcccaaaatcttgagctcaggcagtctgcccacctcggcctcccaaagtgctgggattacaagcgtgagccaccacgcctggcccattctttttcttcattcctgacagtgcttgcagcagaccccaatagctctgggcagagattagttattgtaattctttggcactactcttggctaaatttattaaaactgaaatgtaaataagctttagatgtgccaaagatggagatattacagtacaaaagaaaccgaatgttggatgtagtattataattaaatcactttaagataggtaaaaataaaaagcctgaattgttgaaaaaacaaataaattagtttattatctctatatgtcctttcaagataatctgcagttcctagaattttatttaaatgtttattttgaaactatatgtttgaataaaaactgaagactgtcctttttccattgtgtggttttgacagccttgtcagagatcatttggctatgtatgtgtgagggtttgtttctgggctcactattctgttccattggtctgtatgtctttatgtcaagaccacactgttttgattactgtagctttgtaatacgttttgaaataaggaagtgtgaggcttgcagttttgttctttttcaagattgtttttgcttttgggagtcccttgagattttatatcaactttaggattttttttttttttactatttttgcaaaagataccattgagattttgataaagattacattaaatctgtagattgctttgagtattatggacatttaaacaatattgtttttgattcatgagcattatccttttttttatatttttaatttctttcagaaatgttttgtagttttcagtgtacatgtcttttgcctctttggtcaagtttattcctaagtattttatccttcttgatgctactgaaaattgaattgttaagttccttttcagtgtgttcattgtttgtgtatggaaacaggactcattttttgtgtgtcgattttgtatcctgcagttttcctgtttgtttcttagttctaatattttttttcttttgcatgaaacttttagagttttctacatacgtcatgtcatctgtgaacagagattaattttacttctttttaaatttgaatgcctttcatttttttgtgtgtgtgtaattgctctggctagtacttctagtactatgttgagtagaagtggcaagaattgccttgttcctgatcttagaggaaaagctttcagtcattcaccattgaatgtgatgttagtggtgggtttttcatatatggtcttcattatgttgagatagtttccttccattcctagttgagtgttttttatcatgaaatgttgttgaaacttgtcaaatgtcttttctacatccattcagatgatcatgtagtttttttcattctgttaatgtggtgtattatattgaatttcatacactgaaccatccttgcattccaggaataaaccccacttgatcattatgtaaaacccttttcatatgctattgaatttgaagtgtagatattcttttcttgttccttaagaaaagcatcttgtctttcaccattaagtataatgttagctgtggattctttcatagatgcccttcctgttgagttttttaattataaaagcatgttgtaattaattaattaatttatttatttatttttgagacggagttttactcttgtcacccaggctggagtgcaatggcatgatctcagttcactgcaacctctgcctcctcagttcaagtgattcttctgcctcagcctcccaagtagctgggactacaggcacgcaccaccacgcccatctaatttttgtatttttattaaatgcggggtttccccacattggccaggctggtgtcgaactcctgagctcaggtgatctacctgcctcggcctcccaaagtgctgggattacaggtgtgagccaccgtgcccagcctgcatgttgtaatttattaaatgctttttcaacatctgatgagatgattgtatagtttttcccattattctattaatatggtgtctaacactgattgcttttcatatattaaaccagtagctgttggattttgtctgattccagatgacctatgctacctcctagaggagtaaataacattttccacttctgacatttgtggggttttttaatcaattctgaattttatttttgtttacatgagtatagggctctaattttatttttttcccaaaacttcctttgaatattattctagatcttactctgttccactggtctaattgtatacttttctgctaacatggaattattgtatagttgacccttgaacaacaaggggattgggatgccacctttgcaacacacacagtcaaaaattcacatgtaacttttgactcctccaaaactttactataacctattgtttaccagaagccttaccaataacataaacagttgattaacacgtattttgtatatgtatgtattgtgtactgtattcttacagcaaagtaagctagagaaaagaaactgttactaagaaaatcataaggaaagaaaatatatttactattaagtggatcattataaaggttttcatacttgttatgtttgcattaagtaggctaaaggggaggagtaataggaggattttcatcttgctgtctaagaggtgacagaggtggaagaaaatctgtgtataaatggacccacacagttaaaatctgtgttgttcaagggtcaattgtacttaattttttgattgtttttaaatttttaaatagataatacattgatgtacaaaactcaaaagttacaaaagggtttgcaatgaaaaggaagtccctctttcacccttatttcagtcacaggtgttgctttcagttctttttatatttttactggggtagctgctgcacctacaaacaaacatatttgcctcattcttttttagcagctacttagtaggcaatagattcgttggattctgtgttattaaatattcccctgttggtcaacatttgggtagtttcttgctgttgaaaacattgctgtagagaatattctgtgatatatatcactatgcacttgtctaaatatagccagtagttttataattcctagaaatagaaagtgcatctaaatattttttgtagatgttgccaaatttccctctagagaaaggtgtgtttgctaatttataatcttacaggctctgtaagagactgttttttcctcctgtgccttcaacgataccatgtgttattaaactttttgatcattccaaattaacagcgaaaatttataactcattatagttttaacttgcacttctcttatgggtgagggtgaagtttgttgttgttgttgttgttgtttttaaaaatatattttttaaattataaaagcacatcgttatttatttatgagcggagttttactctcgtcactcaggctgggtgactatatatgtatatatatttcttttttttttttttactcttcaaagttccttgagctttttattttgaaatttggtggttgggctttttacccttttttatagacttaagaaatttagcactttgtgatataagttgtgactactttttccattgtgattgtcttttgagttttttttatgattggtgttgcacattagccatcagttcttttttattgctaagtaatgattcatggtatggatatatcacaatttctctaactattcgaattatttaagagcattttggttgtttacagtttctggctatcataaataatgttatcctgagtattcatgtacaggtgcttgtatggacataagttttcttttctccaaatacatgcccaggaatggaattgctgggtcatatgtgtaagtatatgggtttttgggggttttttttttgggagaaaataccaagttgtcttcctgagtggctgtaccactttctgtttcttctggtattgtatgagaggtccagtttttctctgtctttgccagcatatttgttattgtcactttttttatttttagatgtttaagtatgtatgtagcgataactcattttggttttaatttacattttcctaatgactaatgatgttgaacatctttccacatacttatttgccatctgtcgacatacttatactctttggtgaaatgtctgtgcatatttttctcattctttaattgaattacttgtttttatattattgacttttgagagttcctttgcatattgtagatactagttttagtcagagatgtagtttgcaaatgttttcttccagtctgtagcttgtatttcttcgggaaaaaaaaaaaaaaaacaccttttgatcttgaaataattacagatttgtaggaagttgagaaatgtataggaacatcctgtgtactcttaacctagccttctccattgttaacatctttcttaatatagtgcagtatccaaactaggacataacattggtacaatacacagagcttttcagattttattagttgtatttgcagtcatgtgtatttgtagctctgtgcagatttatcacatgtaactaccaccacaataaaagatacctaactgtcctgtcacccacaagactccctcttgctaactttttgataacctcacccactctctctagccccagtggttcatccaagttgctgtgtatatcactagtttgttccttttaaggggcggggaggggggcgctgagaagtattctatcatataatgtagtttcatttgtttaaacatttaccagctgaagaacattagtgtagttttctgtgtttggctgttaatgaataaaattactatgaatattcatatacaatttcctgtgcaaaaataaatttttatatctctggtaaatgcccaagggttatcagttgctgggctgtatggtagttttagttttagttttaaaaggtctgcaaaattattttccagactgactgtatcattttacattcctagcagccatgaatgaatgatccagtgtttctgcatccttgtcagcatttgatgctatcactattttttagttttgccattttgataggagtatagtgatatctcattgtgttttgttgttgtttttgttttgtttttttttttttgagataaggtctcgctctgtcacccagggtggagggcagtggcatgatcatggttccctgcagcctcaacctccctggctcaggtgatcctcccgcctctcaagcctcccaggtagtcaggactacaggcacacgccaccacacctggctaattctttgtattttctgtagagacagggtttcaccatgttggccaggctggtctcaaactcctggagtcaagtgatcttctcccctcaacctcccaaagtgctaggattacaggtgtgagccaccgtggctggccttcatggtggttttagtttgcatttccctaatagctaatgatgttgaacatccttttatttgtttatttgccatctgaatatcctcttcagtgaaatatctttttatgtcttttgtcttttctaattgcagtgttttttttttttttttaacttatgagttttcagagttctttctagattctagattctagtccttcgttgggtttgtggtttgcagatcttttctcctgtggtgtaacttgtctttttttttgtttgtttccttgtttgtttttgacatgggatctcactgtgttgctcaggctgcagtgcagtggctgttcacaagagtgattatagtttaccttaatctcaaattcctgggctcgagcagccctcctgcctcagcctcctgagtagctgggactacagatgcatgccactgcgcctggcttgtcttcttaataggatctttttacatagaacaaaatgtttaattttgaggaagtctcatttactgatttgtttctttgttagatttgtgttttaggtttctagtctaacaaccccacttgcacacccaccccacttttttgacttgctctgtcacccaggctggaatgcagtggcatgtgatcatagctcactgcagccttgaactgctgggctcaggcaatcctcctgcctcagccttctgagtagttgagactacaggtgtgtgccatcgcgcccaactaatttattttttactttttgtagagacgggatctggtctcatactcctggcctcaagtgatcctcccaccccagcctaccaaaacactgagattatgggcgtgagccacagtgcctagccaagtcaaaaacctctctgcctgactttagatttggagatttttttttcctcgaaagtttttatttttacattttacatttaaatctgtgatccatttgttactactttttataaggtgtgagattgagattgagcttcatttatggagatctaactgttcttagacccctgttgcaaaggccgtcctcctccattgaattacttttgcatctttatcaacaatcattgtctgtacctatgtgggtctctttctgggtcctctgttctgttccattgatcagtgtttctgtctcccaccattaccacatggtcttgattactatgtcagactatgtaataagtcataaaattaggtagagtaattgcttttactttgtttaaatattcttctagttcttttgcctttccacacaaattttagaattatcttctcgctctacaaatagtcttgctgggattttgataggaattgcattaaacctgcatatcaatttagggatgattaataatttttctattttgagccttccagtatatgaacatggtatgttgccatttgtttagatcttttttaaaattttattcatcagcattttatagttttcagtatatagttcccacacttgttttgttagacctgtacttaaatattttgtttttttctgagtgattatatcttgtgaccttgctgagttcacttatagttctaggaagttttttgtaaatttgaggggtatttcttcatagactaccttgttttctgcaaacagggacagtttttatttcttaaccatctgcctgctgccttccatttatttactttgccttattgctttatggctctaatagagtgttgaataatagtggtgacagtgaacatccttctttgatttttatttcttttttttttgagacagggtctcattctgttgcccaggctggagtatagtagcacagtctcggctcactgcaacatccgcctcctggactcaagtgatcttcctgcctcagccttctgagtagctgggactataggtgcgcaccaccacacccagataattttcgtattttagtagagatggggtttcactatgttggctaggctggtctcgaactcctggcctcaagtgatctgcccgcctcgcccacccaaagagctaggattacaggtgtgagccactctgcctgacccttctttgattttgatcttagggggaaagcttcaagataaaatgatatttttttttctgtgtttaggcttttgcccttgaatctaccatgttttgtattattatcctttttttttttttaagcttttcgttagcatttgtctgacataaactttgttcttttgttttcaaccttttgtggtgtttatttttgggttctttttgattttttgttttaaaatagctttattgacatataattcatataccacaaaatatattcctttaaagtgtacaattcattggttttactatatccacagagttgtgcagccaccatcactatcaattttagaacattttcatcacccagaaaagagcctctctacccattatcaatcactctttagtgccacctctcccatcccctgaaactactaatacggcatctgtctttatagattttcctgttttggacatctcatatgaatggaatcgtatggtatatgaccttccgtgactggctgttttcatttagaatgatgttttcaagttcataaagttgtatgtgccgaaactttgttctttttaatggccaagtaatattccgttatatggatataccacattttgtttatacattcatcagttgatgggcatctgagttgtttccactttttggctaatatgaatattcgtgtataattttttgtgtggaaatatgttttcaattcttttggttaaatacctagaactagaaatgctggctcatatggtaactttgtttaacctttgaagaactgccagactgttttctaaagcagctgtaccatttatattcccaccagtgatttatgaggattcgcatttctctccacatccttaccaacacttgttattatatgccttttttaatatagtcatcctagtgggtgtgaagtgacatctcattgtagtagatttctctcttacaaatagcacgtacctggctttttaaaaactcagtcttaaaatttaacttactctcattttatgctaacgttgttacatttggtctttgttctgccatcttaatttgttgtctgtcatttttttctgacctctgtgatatgaattatactttgtttctcttttattttctaatggtttgggagttctgccttctatttctgtaggtagttactattgaaattttacccaacacatttaagcctaaattttactaccaacatcaacaacttttaagagtaattactgtgtcttgcctcttctcctcttcactaatttattctatcagacatgtattcatagttgtttcttcaaaattcatattaaccacagagagacaaatatttcgtgttctcacttatatgtgggagctaaaaacaattgatctcatggaggtagtgatgatggtggttaccagagggagactgtagttaataagaatttattatgtatttcaaaatagccagaagagaagatatgatgtgttcctagcacaaagaaatgataaatgtttgaggtgatggatatcctagttaccctaatttaatcattgcacattgtatgcatgtacaaaaatacatattccataaatatgtacagcaattatgtaacaaagtttacataagggtctctgacagaagaagcattttcccacattgcatagtgacagccaaaatcttaataggtacaataattaaagttatgaaagaattgctattgaatgaagaaaatatttgtctttagtgctttactttagattattttgagaggactatagtgtatagctaagaagcaatcattcaactcagggtaggtgggttaggtttaagaaaatctgatgactccattgagaattgtattaaagctcagccaagagagctgagctgtaacaatatttaatttgccacattgcagtttcatccatctagaagtgtaggaaattcaggttttcaggttcactcaggatatgaattgttaacttcctcttagcagagataatatattactatttaccagataatcttaatactctaacttatatttttacttcagaagtttttctagaatttatctaggttacttttagataagtaaatcaggccatttgtttgtatttattattggtatatttctgtataatttccttatgcctgtgtagatcgtggagttcttttgaagtcaatttcaagtcaagattatatttatgtacatgatttttttctcatatttctcactttcccaccatatgatctaggtttgctacatcagaattggagagtgacatttaacttagtgtttccggaataaagaatctggagcttttactaccccataagtaatctattttagcctttctaagtctgcagcttcctttcactttgctttccaatctagcatttcacctctagttttaccccagttatgctttatagattaaacctctgaaatgtgtttaatctgtatgaaatgaaattatagctgggcacagtggtgcacacctgtagtcccagctacttgggaggctgagcatgagagtcggttgagcccaggagttccaaaccagcctgggcaacatagcaaaacgccatctctaaaaaaaattttttttaaataaataactaacagtaaccttaaaatgaaattatggttcttaatgatagtggcttgttacatctcttatagccccacataggttagatttttcaatataaaattagaggataggcacattctttctttttagatgcttaagaaattacctcacataaacattttaccatttaaaaaatgatgtttaccagtccatttcagttcttcaactgaggtccattataaaatatactacttttgctgtataccaagctacagttgtagatattgattcaagtaaaggtgatacttcctcttccagttgatttttatactcttaatttgtgtatacatacattttcacacatgaatatgtgtgtgtaagagacagagtgcattcatttgcacccagggttggaggaaagaagagaaagaaatgagaatatgtatattggagatacttggctatttgtacctcacctgcccatgaaggctaaaaatggatggttaaacacctgtctctgtgctcatgatgaaaatgacctttgcaaaaaaaaaaaaaaaaaaaaagaataaacaaaagaaacacaaacaaaaaaactttagaaaataacctttgcttctagaccttctaaatttttctgaatggagagttttgtggtttccaaaagtgaaatagtagaagcaggaagaaaatattctcttacctaggtgcaaaactggcccaggccaaattctaatagacacttgcctttggcagtctcccagttgtctctcttcatgtttcccccacctttgtctgccccctccttagttgtgtgttgagctcctcactgtgccattttcctcaggtctgtagacatgcctcttcttataccccacaaaatcccctccagtttcctcctaatattatctataaagcagaagaaaatagcctgatctgtagagtgaagggggattaggctctaacgtcagtgtattagccctactgctgaaaattcctgaaattcttaatcgattacaatagtgttccatacttaaatacagcacagcaagcttttctccagcattgtgttggatcgctgtttctttggttgaacacagatgatgttgggttatatttaggggccacatagtttgaaaataattcatgagtgtttaaaagactagcatattcagcatggtaagatgcactcgtgaggagatgggaccctttgtacttcctagagtacaaagaaacactgacctagagaaccatattctaagaagtctacttttgtttaagcatttttctgggtcagctccagtaaatgaatcttgctattcataatatttcttcttctgaacctataggtttttaacttagggatgagagtccaggatagtagctatttgtacatgtttgcttattttcaatttatgtgtttgttagggattgtccattaacttacagctgttttcactctgatcattgttcctagcaagtatgcttaggtatggtctcacttcctatcacctcactctaatgagtcctcttaatccttatcagaaggaaattccatttcttcttaggggaaagtgaccataatagtgtgtaagattgagttaccttaagttgtatatttcagaagtataaatcaatatttactcaaatgcctggaacttctggttcatctgttgtgaatataaaaccacttatgggcaaatgttaagtgtctagtatttataccagatatttatagtctttggagcctttcctaggatcatgaatttaggctgctactcaatttttaatactttacccttatactttcatttgaaaaagaaatgattgtttagaatggatttgaaagtgtctattaaactatatctaagagcaattataaaactaataatgtgtgatgaaagataagatggtcatcagttataaacaggaaaaaagctgatggtaaatacttatgcttatacttagctagataaaacacacatttaagaaaaaaaaaaactctaaatatacagttactttgttcctatatataccaccagtaaatacgatacatggtttgtaggtagtgaaatattattttaaatgatttttctttctagaattagagtatagccagaaactattaactaatcttgtacaagaaaactactagaaaatcaacagtgaggaagagttagaattaattaaaatctacctaaaactagcataagcataaaagctaatccatcaatttatataaccaaagattaaggagcttgatgcagagctcaatgaacatcaccataatctttttcttgactctccatttctcttgccagcccctgccacattgcttggatcctcagcgtggcaaaattccatagataagttttctgtagtcactgtctccagttccttacctttcattctcctgtaagtctactccagtcatgcttttgcttcattcaatccactgaaacttctcttgtcaagaacacctgtgatgccaaaccccatgatctgttctcagtctccaggttccttgatctgttagtacttgacacagttgatgaggttctcctgcttgtgcactttgtcacttgacttccaggattccacactctcttgattttcctcctatcatgctagtcatttcttcttagatgtctttcctcgttcttcctcttctcttctcacactcactcccttgatgatttgaactagtctcaaggccttaaatagtaattaaacactgaggaccctaaatttatatctcaagacctctctcatgagttctggagtttcatccgactgcctgctttatatcaccattcatatagctatctcacacttaacctgtctaaaacaactttttttcttcttccaaaatgaagtctaccctcagtattctcccttttggttaagagtatcttcatcctttttgttgctcaagtcaaaaactctggagttatcctgactcttctcttttgttatgttccagtttcattagttaggatgttttattggctccacccttaaagtatatctagaatctgaccattctcatgacctttactgctactatgcttatctgagccaccattatctctcacctggattattatgttaatctctgtgcctacctttgttccctgtataatattctgaatttagtagccagagtgatacttttaaataaaagctaatcatgttactcctctgtttaaaactctccatttgcctggccatctttgttacctgtctgatatcatcatctataactattctttctgttaccttgactctaacaacactggtctacttgctgtttctcagatactgtgtatgctcttgtcttgggccttggcatgagtgttttctttacctggaatactcatcccacaaacattcacgtggccatctccttcatcttcttctagtcaaggtattaatatgtctgatgagacacctaccctgactaccctattctttccaattcccattacactgccctattatttccataacattgtcagcatctgacatactttactatgtgtattatttattttctttctcttctcattacagtgtaaatgccataagggcagtggtttgggtctcttgtttattgaagtatgctaagcacctagaatattattttacatatactaggtactcagtaaatattagttgagtaaatatttgtagaacagattcatttcatattctccattttgtggttctgcttcctttatgtcaagaccatgtttaggcattatatgggtcccagaagttcctgaaaaccctccagattcaaatctagccagaaagaggataaatctttgtcctagcattcccaggaaaaagactgaggttcactaaactattttaaaatgccttattcagcccttgaccagtcagccctggccaggagaaacgcaaaactctttttggcctagacttgaaagttggtcatatgttccaagtctgaaactagaggtaaagatacaaacaaaaatgtctattcagggaattagaagctactgaataagcacacaagaaatgtctactcacttttgtataccattggtttacaactgtgatccttggttactggctgcatgggatgttagtaggtgctctttgaccatgccccattaagttaaaaaacttaaatttaaacaatttttactcctgtggaatttctcaatttttaatatggtaatgtattttgtgaatctctaagccagatatattttatgcatcagtttccccaaattctttgaacatgaaaccgtttttcctccagaatatctcaaggtatattctcatgcagctcactatgagaaatattggtatgtccgctaagaattagaaaattgaagaaaaatctcatgcaacaataaaaaagaaaacaaaagaatacttttcaaatgtacaggacctatttgaagaaaaaattttttacaggcccccaaatattttaatatatagaaagacagtcctttgaaagatacttacggctgggtgcagtggttcacgcctgtaatcccagcactttgggaggccgaggtgggtggatcacctgaaggtcaggagttcgagaccagcccagccaacatggtgaaaccccatctttactaaaaataaaaaaattagcccggtgtggtggcgggtgcctgtaatcccagctactcaggaggctgaggcaggagaattgcttgaaactgggaggcagaggttgcagtgaggcaagatcgcaccattgcactccagcctgggcaacaacagtgaaacttcttctccaaaaagaaaaaaaaattagctgggcatggtggtgcgtgcctgtagtcccacctactcaagaggctgaggtgcaaggatcacttgagcctggggagatcaaggctgcactccagtctgggtgatagagtgggaccctgtctccagaaaaaaaaaaggtatttattctcaataaattctatgtagttgcagtttaaaatctagtttagtagagaggggtgtgacgggaagaggagaacttaatcaaatgattctaaagtttcattttgttgtagactgtttttattgcaagaaagcataatacctcaggttacctaagaaaagtttattgtattgaatatatagggtttaaaaccagtatcagacagttatgatatgtactttctctggttggctgtgtgcttttttctctccctctgtggcatccgtatatatttgtaagcatctgttttgtttgcttatggttatctgctcttagtccccatactccatactccaaatcttgaattaaactgctttgggttgattttagttaatctgtcactaatggatggatccttttaggccttctcattttattgattgtccagaagccagtagatgggctatccctgggaaaattatgctccctgatcctgtcagcatctgctcaatcctacttctgtggtcagaggtaagggttggcaagatttaactagaaggcgaagttgggtgtgttaggcatcatgactaaaataatctagaagaaaaaataagaatagccagaggaattctgaaaagagagtatctctatatattgcaggggtgtagtaatttaagctgtggaactggtgcctgaataagcagttaataaagtagaaatacaattttcaaataacataaaagtgaaattactaattagaggtatgaattggatgttaaattgttcaggagtacctaattggccgttaaaaagtaaaattcctatcctgcaatttaacactaatatcaaaatggtttaaagatttaaatgcttaaaaatgaaatagtatcagaggaaagtacaggttgcgttgaaataaatgcatagataatatttaaataatattgaggtgaggaaggaattttccctagcgtaaaactactgagagttcattaagattttattgtggagattcaaaaagaaaggtttattatactaaacgggaaaatgaataaactaagggggaatatttgaaatatgaccatagtacatattttaatatagaaaggactgttagaaacaatttgtgtgtggattgggggtgcttaatcctacctggccatcatacagtattaccctagtccatacactctccatacactttcttaggtgacttttgtatcttattctcttactacatacttccaacaactgttgttgagccgtaactctttggtgattactttgcgttttatttcttcctcactgagaaaatggaaccaatcagaagataacttataaaggcttccaccaatatataccttatgcccatgtgcctacatctctgtccgtttaccgtatatgttttcttctgtaactgagggtgaatgctctggtatctgtactgagaccagattctacacttgcacattagatcctactcacttgcttattcaaggatattgcttagtaattctttctctgctacattatcaattttttgcctctttactagctcagtcccccatcttaaaaaaactacttttctcctaatttccctccagctacatccctattttcttttccttcaccacaaattcctttccagagatgtctcaatttactgtctttgatttctttcctcctttctctcatgaaccctttccaggtaggtttttgactagctcatgccaaagaaactgttgttatctaggtcatcagtgaccattataccaccaaaaaaaagtagtcatttcccagtttggaagaattaaatctttttaaaaaatgtaaagaatgcctactacagcctaatagggtggttcacaatacagaaaaaggccaataagggtatgaaaagtagtcaatttctagaaagtcaaagaaatgcaaatttaagacaataagatgtttcttattcactgtccagtgtcggcaaggaaatctagaactctcatataccatttggttatgcaaatgaaaattggtacatttctggaagcaatttgacaatttttacaagagctttaaaattgtgttcgtcttttgacttgcccattctgtttctaagagtatgtctcggaaataacacacaaatgcatgatgcatccacccacatacaaccagggagggaaggattcatcaaggcattaattctggaagggaaacatgaaaatgacctaagtgtttgacaataggagattggttaaagtatgctacatctatatggtagaataccaagtagctacttaaaatgatgacattggtttgtttatttatttgaaattattttaaacttttttcacatcaagttgccattaaagatatgtttattaacatggaaagactttaatatgttttaagaagtgtattcaatgcaaattttgtggggaacaaagtatattacatgcatgtggttatatgtgtgcacatacataggtacatatcaatgtatgtataggaaaatgcctagaagattgtataccaaaatgtttttcagctgctgtcaagtagtacaattttagatgttcttttaaaacttggaatgcttgcattaacaacaacaaaaaaagaaaatgaaagttttgcaaaagaaagaaaatcaatatcccaattatagtctgcttactttttctggttttacattcaaacattgatcattagacttggttcatagctggctggcttgaactgacccagtcctgtttcataaccctgctggacttaaaacagcctaatggtctgccagctgtgagagaatagatgagccagataaagtgtatttaccatacttttaactcctgagctgcttgggagtctttatagactcctttgattaagtctaccaggagaccagctactaactcagtaaactaatctgaggaataatgtaaagttagaataactaggataggtagagttaaactccagagaaaaaaggtgatgaaaagtataaggcaagcttattaaggatgggcttattaggaacctgataaaaggatgtgataaaaatgaaatcaaagggttttacagtgctaaagtttaatagtattacatgttggaattgtttcctgtttcttagtataggtaatttctgtatgaatggaaaattcatgtgtaatttttgttgtactccaaagaactttagccacaatttattgtgaaatatttgcaaccttgaaaattcagaaatctagcaataggatctctctctgtctctctcttgctctagcaaacgactgcatatatttcatacacacacacacacacacacacacacacacacttatatacatgtatagtatattggttttgtataaggtataaaaagcaaattattataaaaacaatacatatgctcaatgtgaagaattttgtaaataaaagttacaaaggagtcaatttttgctgcctttttcaatctttcaacgcataatatgtaaatttgcttatttatgctctatacttcatgtttatatcttgtctttttcacttaatattttatgactgtattctcatatcattaagtattctttcctttaaaaattcccatttaaagatagtcaaagcaatatgaatttgttaatgatttagtatatgaattggagaaaacatattttctgcagtcttctttcttaatgggagctgacagcctaatgatgaaactatatcattccagctatattttaaaaaattacatagttgtcaagtttttgtttgactaagtcagagggttcattaaagattgtaaggctgacattcgtagataggaactttagtttcactttccctaagacagcaagaaatattctataacagaaagatgactatttttagcttttctttctgctggtgaggtggaatagcaaatatttttagagcaattgaaagtacagcctcttagattagctcagtgtttctatcatcagaatctcaattattttatgtatctagattttttttttacttccaatgttttgagtttatgtaaattgcaacatgattcgtctttttatttttgatctagttcgtttctctgtggaacaatataaaagatgaaatttctaaaaccttaacttttctttctgcactttttatgtattttgagttgtaattatattctgcttattgtgggcagttctcttctttcttggagatgaaactttgataattaatacttacggggagatggtgttacaaatcttctctcataataggctcttaatattcacaagagagatcccccatgaccattgtaagtacccttaattatgaacaccactagaacatttcatctttccccaaaacgatgccataggataagtgaaaatttgagggacttctgtttttacccttaatgaaggacatcttggttgcttccaggttttggcagtataaataaaggtgctgtaagcatccatgtggagggctttatgtggacatatgttttcagctcctttaggtaaatactaaggagtgtgattgtgggactatatggtaagagtatgtttagctttgtaagaaactgtcaaactctcttccacagtacatggtgctatactgtaaatggtattttttttatttcagtttctgattgtttgctgttattatatggaaatacgactggtttttgtatagcatcttcaccttgctaaattcgattgttctagaagcgttttgtagattctattgaattttctacataggtcatattttctatgaatagacagttttactcttttccagtcttgatgcatttttcttgctttattgtgctggcaagaaccttcagtataatgttgaatagaaatggtaagagtggatgtcactgcctcattcctaatttttgagggaaaacattgattctttcacgtctcagtaaagtgtttcctgtaaattttcatagctgtctattatcgatttgaagatgtttacttctattcctggtttctggagagtgtttattaggaatggttgttgggtttttgtcaaatgcgttttcctcatctattgagctgttaatatggtgtttcttttttagtgcgttaatatggtgacttgatttttgaatggtgaaccagccttgtatttttgcaacaaatctcccttagttatgataaattattgtttttccatatggttggattttatttgctaaagttttattaagagtgtttgcatttatgttcatgacaggtaaatggttggtaattttttgtctaataaggtcttggtctcattttggtaccaaagtagtactggcttcatagaatgagttaagcatttctttcttttccatttttttttggcgaggatggggaagagtttgtgtagaatcaatattttttcttgtcaggtagaattcttcagtgttttgaaaacatttatgtagggttggtattatttttttcttaagtatttggtagaagtcccccgagaatacacatgggcctagagttttctttcagagaagttatcaaattacaaattcagattcttgtagggctattcaggttatcttttttcttaagtaaactttggtagttttttgtcttaagacatttgtccattcttgctgagttataagtttttgtcataaaggtacgccaaatattaataatattctcttcacatccatagaatatgtagtgatataacctcttattcctgatatcgacaatctatgtcttttcttctttgttctcttgattagtcttgctagagatttcattttgattttcaagaagaaaccagcttttggtgtcactgatttttctatatttttgtttttcaatttgattattttctgctctgatctttattattttctttctcctgattcctttgggtttcatttctcttctctttttttagtttcttaaggtataaactgaaaccattgatttaagaccttttttttctaatataggcattttagagctgtaaatttctctctaaatactgctttagctgtatcccacaacttgtgatattttttgttttcattttcattcagttcaaaatattttgtagttttccttttgatatctttgacccaggggttatttagaagtgtaatagttcccaaatatttgggcattttcctgatatagttcttgttttttaaactaacacataaaaattgtacatatttatggcgtacaatgtgatgtttcagtacatgtataaattgtgtagtgttcaggtcagaataatttgcatgaggccttaaacattcattgtctgtttgtgatgaggacattgaaaaacctcccttctagcgtttttttgttgttgtttttgtttttttgttgctgtttcgtttcttgagacaaagtctcattctgtcttgcccaggctggagtacagtggcatgatactgtttcactgcagcctctgcctcccgggttcaagtatttctcctccctcagcctcccgagtagctgggactacaggtgtgcgccaccacacctggctaatttgtatttttagtagagttggggtttcaccatgttggccaggctggtctcgaactcctgacctcaggtgatccacctgccttggcctcccagagtgctgggattacaggtgtgagctgccatgcctggccccttcttgctattttgaaatatgcaatacattattgttaactctagttatgctaccatgcgttagaacacgagaatttatctatctaactgtagctttgtacttgtggaccaatctctgcctatttctcttccctctgtcctccccagagttctcgtacccctattctattctctacttctgtgagaacagcctttcagattccacatgtggatgaaatcgtgagatatttgtcttactatgcatggcctatttcacttaatgtcttccaggtttatccgtgttgccacaaaagacaggattttattctttttgtggctgaatagtattctatcatgtctccataccacattttcttcatccattcgtctctctgtggacatttaggttgatttcatatcttgcgattgtgagtagtgccacaataaacatagttcagatatctttttcacatgctgatttcatttcctttgggtgtatatccagtagtgggattgctagatcatatggtagttctatttttaattttttgagaaacctccatactgttttcagtaatgactgtactaattaacattcccaccatcattatgttaagggttccctgttctccttatccttaccaacacttgtcttctggttttgtgtagagtcagagtaggccaggtgcagtggctcacgcctgtaatcccagcactttgggaggccgaggagcggggcagatcacctgaggtcaggagtttgggaccagcttggtcaacatggtgaaatcctgcctctacaaaaattagccagatgtggtggtgtgcacctgtagtcccagctactctggaggctaagacatgagaatcacttgaacctgggaggtgaaagttgcagtgagccaagattgcgccactacaccccagcctggatgacagaacgagtgtctgtctcaaaaaaaaaaaaaaaataataataaataaataaagagtcacagtcttgctctgtctccgaggctagagtgcggtggcacaatcatagctcactgcagccttgacctcctgggctgaagtgatcctcctgccttagcctcccaagttgctgagactataggcatgcaccaccatgccctgctaagtcttttaatttttttcttttggaaatgggttgtcactatgttctgcaagctggtctctaactcctcgcctcaagcgatcctcccacctcagtctcctgagtcactggaattacaagtgtgatccactgtgcccagctgtcttgattttttgacagtagccattctaactggagtgaggtgatttctcactgtagttttgattgatttgcatttcccttattattagtgatgttgaacattttttcatatatctgctagccgtatgtatgtcttcttttaagaaatatctaaattcaaagtgaattagagatttaaatgtaagatcggaaactatgaaaatagtaggaaaaaaacataggagaaaagctctgtgacattggtctagacaaggcttaaaccttgaaagcacagagaacaaaagcaactatagacacatggcattaaattaaactaaaaagcttctgcacagcaaaggaaacaatcaagagagcacaacaacctacagaatgggagaatatatttgcaacctatacatctgataaggggttaatatataaagaactcaaacaactcagcagcaacaaaccaaataacccaattaaaaactgggcaggccggggcatggtggctcacacctgtaatcccagcatttcgggaggccgaggtgggtggatcacttgaggtcaggagtttgagaccagcctggccaacatggtgaaaccccatctctaccaaaaaaaaaaaaaaaaaaaaaaaaaaagtatatatatatgtacacatacacacacacatactccagacgtggtggcgcacacctgtaatcccagctacttgggaggctgaggcaggagaattgcttgaacccgggaggctgaggttgcagtgagccaagatcatgccactgcactccagcctgggcaacagagcaaaactccataaaaaaaaaaagtaaatgggcaaaagacctgaatagacattcctaatatatttctgttatttagtttaattgaattctactgtgggacagtatactttgtatgacttgaatcctcttaagttaattgagatttgtttttgactcagaatatggtctatcttggtaaatgttctgtgtgcatttgaaaaaatacacattctgctgttgttgagtggagtgttctataaatttcaaagatcagattggttggtaatattgttcaaagtcttctgtattcttccaatttcctgtccagttgttctatcacttattgagagagggatgttaaaatctttgctcataattgtggatttgtttatttctcattgtagttctatcagtttttgcttcatgtatttggaagctctactattatgtacatgtcctcttgacccctttgtcactatacagtgactctctctatccctagtaatattttttgttctgaaatctactttctctgacagctttggtttttgttgtttgctttttgcttttgtttttattttttaaagatggggtctactgtgttgcccaggctggattcagactcctgggctgaagcgatccttctgcctcagtgtcctgagtaggtgggactacaggcccatgccaccatgcccaggtcatccagctttgttttggtcatggtatatcttatccttctttgttaccatgatgtatcttttctatacttttactttcaaccaatttgtgttcttatacttaaagtggatttcttaaaaacaggttatagttgtctttttttttttaactctctcatatctgccagtctgataatatcagccttttaattgggttatttagactatttacattttatgctattgttgatatggttgcttttaaatttaccatcttggtatttattttctttttgtcttatctgttattttattcctctttcccctttttcatatgccttctctaggatgattttttaatgattcaatttttgtctcctttgttggcttattaactataactctttgttgtgttattttagtggatgctttaggttttgtagtatacgtctttaattcgtcacgaccctacttcaggtgacattttaccactttacaacagttcatttttattttccccctcctggtctttgtgctattcttgtcatacattttacgtccatgtaagtttgttgttgttgttgtttgaaacagagtcttactgtgttgcccagactggagtgcagtggcgtgatctcagctcactgcaacctccacctcccgaattcaagtgattctcctgcctcagactcccaagtagctgggattacaggcacccgccaccacgcctggctaatttttgtatttttagtagagacaacttttcaccatgttgaccaggctggtcttgaactcctgactcggcctcgcaaagtgctgggattacaggcatgagccaccgggcctgacctacttctataaaagttttaaactgcagtatgttgttgttatttttgctttaaacaatcagttctcttttgtggatacttaaataaacaattctttatatttatcgatgttgtttccatttctgatattgttcattcttttgtgtatatccagattctaatctggtgttgttttcctattccttgaaggactttctttaccatttctttaaaatgtaaggactgtggtgaattcttttaccttttgtatgtctcagagtttttattttacctttgtttttgtaagatgtttttgctgagtaaagtgttaacagttgacatgtttttttgttttttttttttcttttggcacttcaaaaattttactccacttcttactctgttttctgcttgcattatttttgacaagaaatctgctgttatctgtatgctgttctatatatttcctttgtcttttttcttctggctgctttgaagattttgttttcactgggtcttaagcaatttggttatgatttgctttggtgttgctttattcttgtttttttgtgcatagggtttattgattgccctgcctcagcactcctatttcttttaaattctctcttctcttgctttttcttctgtatttctggccacctcttatcttacttaacctttaaatattggtggtcctagggattctgttgtgttttgattccacagggtattctcaggtcatctcattcactcccataacttaatctgctctctgtatgagagatttcctaattgtttatctctacccagacctctctctaagcttcaggttagtatttctttacagccatctctacttaaatccaaagaagccctattgaacgtatttggaatgaatagacctggaggacagctcactaaaaaacttcaagaggctgggcatggtggctcacacctgtaatcccagcactttgggaggccaaggcgggcagattgcttgagtccaagtgtttgagaccagcctgggtgatatggcgaaactctgtctctacaaaaaatacaaaaaattagccagatgtggtggcacacacctgtagtcccagctacttaggaggctgaggcaggaggatcacttgagcctggaagatggaggttgcagtgagccaagatcgagccactgcactcctgcctgggtaacagagcaagaccctgtctcaaaacaaacaccaaataaactttaagggcaaaggataatctcagagtacttgggcaagttgctagaaaacagtattctcaggggaagcatcaaaggggaaaatggccaagttgatatggtagttgacttcattgtagttccaccagaaagacaaaaaataaacaaacaaaacccttatatctgacagtcgcaggtaacatagcgttgaatactgtggtgaacaagaaattgaaactatagttctcaagggagttaggccctagaagaatcacttgtgagccagaagggaggaataaggacaagggagtcctaggtggcaactattggatggtttagaactctgccaagctaaaaggataatgtgagatttacctgaactcatgaagtgaaatgcaatcctagaggctagtaagttgctgctaggaaataacaatgaaaaaaatcctttcacagtggttctaaaacactttataaatcctatttcttttaattatttaatcattttattttggttggttttataggaagaaaatgaaatgctattagcttaatttgattgccacaccaagatgagtagactctcttcataaagtggggaacaaatgaaaatctttgaaacagaagtgatatgatcagcactgtgcttattatatatacccaaaatacatttttggaagagtaatagtcactattttttcaaaacttagcaatgcagtatctgcagtgattccctttcatttagtttctcatccaactaaataagccaactagaggaaccctaagaaaatagaattttattttctttcttgggaagtatctgcaagaattgagaagcttggaaacatttcttgtaaggtaaaagctgtttttttttttttaagcctaaatctcagagtgttatacatacaaaattctttttatttttttctttttctttttgagagagaaggtctcattctgtctcccaggctggaatgcagtggtacaagcgtagctcactgcaacctcaaactcctaggctaaagtggtcctcctgccttatcctcccaagtagctaggacctactggtgtgagccaccatgcctggcacatttttaaaactttttgtagagagtgtcttgtagtgttactcaggctggtctcaaactcctggcgtcaagcagtcctcctgccttggccacccagagtgctgggattacaggtgtgagccaccacacctgtcccaaaattcttatatgcaattctacataccctcttacacacagagacacacaaagttatgagtttactgttctggggcattttttaaatgttaaaattgcaactactacttagtctcattttcttgtctataagtcttggcatatgtcatgtatctattttagaaaagtaattttaaagttagtagattaagaaacaacatggttgtactaaaaagtgccttatatataaaaaaatctttccatggaataccatggagactatttttccttatgttaaataacatggaggagtctgcactataggaaacaatttgcttagaaactaatttaaaattactcagagccacatctagaaatgtaagtgaactcacaggagtagtacctaattaagtatattctgtgatattatagaaaccttatttataaaaggaaacttgtataatttctgtcttcagggcatttattgataaaatagatgtaccttcactactgctatgcttcattgtaaatgataatgttgatctgtatttgtaccatgtccaaacataattataggcggaaaacacaggcaacaaagatgtggacataatataaacctaaatataggtatatgtatacatatgtgtgaatatacacacacacacacgtatacatatatgtacacatacgtgtgtacatatgtatacacatgcacaaaaagatctgagaaagtatatgctagtaatacctttatctctctgtgtctgtattgtctgaatttttataattgtgtaatctttattgataatgatggtgggaggttatttttattttgaaatgaaaaaataacatgggtattccagagaatttgaatcagggtattactcttgcattcttcaactactgatggctataactatgtaaagaagtaaaacatttcctgtaaagacagtcagaagttaggaagatctcatctttatcctgtggacatacagatattttttctttggcccatttaccacagtcgtgacttccactatttcttgggttgtggttttttttgttgttgttttttgttttttttttttcattcaaagttataaatgaacagccaggtgtggtggttcactcctgtaatcccagcactttgggaggccgaggctggcggatcacttaaggtcaggagcttgagaccagtctggccaacatggtgaaaccccatctctactaaaaatacaaaattagccgggtgtggtggtgcatgcctgtaatcccagctacttgggaggctgaggcatgagaatctcttgaaccgggaggcagatgttgttgtgagctgaggttgcaccactgcactccggcctgagcaacagagagagactctggctcaaacaaacaaacaaacaaataaacaaaacccaaaagttataaatgaatatagtttaaaatgtcaaataggctcattttaaaaatcccatgttctcatattctatcatttctgtctttctaggggcaagtattttgatctcttttggcttttaaaaaaatgtataagtaatatgcttgcattgcaaattgttgcattttcagttttaggcattgtatattgatttcccaccatgggagataagatttggcttatttgccactcctaccgtataatctgtttgtcgccctgtcttgattatattgtaattttgtttggatcatcccatttatactttattatgactatgtaaacactatttgtaagtgagcaatgtagtgaactatttttcatttcttgaatacctttttattttccctgttctggtcattttcttttctttttttttccccctgtgtacttatttctcattcattgccaaaatttttttgccactgtgtaaatctccagatggataagatgaatgtctaaattcatgtgcatgaggtaattctgtcaatttcatgttctatgagaattccctaccagagccttctgaactgatactctgctaaacccaaacacaggatactctgtcatcttgaggtcttctttcattacatctcagatattattttgcctcttgcctgtgttaatcttgtatttcataggcccatgtcctgttctttcttagttttctccctctttttagtgtggcatatctcttagtagttcataggaaaaagctgcatggaaggtaattttttaaataaagcatgcctgaaaatgttttattctatacccatactttatttgataatttggctgggtgtagacttcaacataagaataattttcctttagaattttgaaggcattaatttttccattgccttctaattatagtgttgttgaaaagttcaaagttaggctggtttccgattttttttttctcctttttagagacagggtctcactgtgttacccaggctggagtacagtggcatgattatcgctcactgcagcctcaaactcctgagcttaagccatcctcctgcctcagcgtcctgagtagccaagtctaaggcctgtgttatcatgcctggctaattttgttattttttgtagagacaggtttgctatgctgatctaagctgacctcaaattcctggcctcaagcaatcctcctgccctagcctcccaaagtgctgggattacaggcatgagccactgcgccccagaccagtttctgatctttttctgtaacctgttcttgccccacctctccagaaacatgtaggattctttttatgtgcagtgttctgaaattttattgccatatgaaccaattttagccattatattgggaatacagtggtaatctggaaacttgttctttacttgtaggaacttgtcttgaattatttcattaattatttcttatttccttccttctgttttctctgttctctctttggaactcctattcccagactaaccctctaattttcaaacctgttttcttcctccttgtctttttgctttactttctgggagatatcctgaactttattgtccagcctgtctattgagcttttcctttgtgcatcgtatttttaccctccaagaactttgtgtatacatataaaatacagatgtttcttttttttaaacaataactagttaattgtttttgtttctgtttttgagacaaggctggctctcacccaggctggagtacagtgttggaatcttggctcactgcaacctccacctcccggattcaagtgattcttatgcctcagccttcccaggagctgggattgcaggcgtgtcccaccacgcccagccaatttttgtatttttagtagaggcggggtttcaccatgttggcctgacctcaagtgatccacccgcctcagcatcccaaaatgctgtaattacaggcatgagccaccgcgcctggccttggttaattgttttatagttgtaccatggttataaatggtagcttttttcggagcctttggaaatttatctaattgttgcataatctctgcctgttcccagctaccttttttttttttggtcattttggtcaccattattccacattgaaggctttcctctgatacttagtcgtgctggcatgtctgttcattttttttgacttattttaattaatttatttattttgagatgaaatcttgctctgtcacccaatctggagtgcagtggcatgatttcagctcactgcaacctctcctgggttcaagtgattctcctgcctcaggctcccgagtagctgggactacaggcgcaccatgctgggctaatttttgtatgtttagtagggatggggtttcactatgttggccaggctggtcttgaactcttgaccttgtgatctgcccgccttgacctccgaaagtgctgcgattacaggcttgagccaccgcgcctggtcattttttaaacctgaatgtgacatcaagctttatagacccagttccagttttgaatttctttttttttgagcagttctatctgacttttgcaggatgaaggaagggcagttgtctagctaactagagaggatgaatggacctggggatctgataacttcataagcaggttttcaagaaattccccttgctttagctatattctgttagccccacttgtacaggtattttgcattataaattagatcagttctcctatttcactcagcttcactgctagttgaggatgcgtttttctttggtaactttgttaccactcatatatttgctttccagtttctacactttttgttgccctcctatttctttctcctcatttgggtttattcttttacaacacaaaaacaaaacaggcaagcaaagaaaaatctttactgaccttttattggaattttaggatagagtaaaagaagatgatgtgctaagctagcaatctctaccaagaccacttttttccttttgttttcattttattttatttatgtatttatttatttttgagatggagtctcgctctattgcccaggctggagtacagtagtgtgacctcagctcgctgcaacctcctcctgcagggttcaagcaattctcctgcttcagcctcccaagtagctaggattacaggtgcacgccaccacgcccagctaattattttgtatttttagtagagatggggtttcaccatgtcagccaggctggtttcgaactcctgacttcaagtgatctgtgtgcctcagcctcctaaagtgctaggattacaggcgtgagctaccatgcctggcctttttctccctttagatcttttgtttaggcagttcaacttagcagtctagaatgggaattttcaaatatggctgcccatttagaatcacctggaaaactttattatttacttattttttgagatagggactcactctgccgcccatactagagtgcagtggcccaatcacagctcattgcagtctcaacctcccaaggctcaggtgatcctcctgcctcagcctcctgagtaacttgggttactggcgtgtgccacgacgaccagctaatttttgtacttttagtagggacagggttttgccttgttgcccaggcttaaatgatccacctgcctcggcctcccaaagtgctgggattacaggtgtgagccactgctcctggccaacctggaaaacctttaagaaatattatatctggatctcacaattagtgggattggttgttggctagggtgtggttttagttctccaagttattctgttgtatagctggatttgagaattctgatctaaaaaaaaattttttttggaacaaatgagaaaaagcagcagattctaaaaatatgactgttttttattagaacatcatctgttaaaacattccagattctgctagaagtaataacctttctcagtggtattaggaattgagaatgagtttctctgaagggtctgttcctgtttgcattccaacaaatggacgcagtatccaaaattaagtcttcattggaagtgagaaatagtattgtagaaaatcaaattagtagaacagaggacaaacttgagaagcagtcacagaatgtacaataaataaatgttagaaaagataaacattgataatgaaaatctaaaatagaaataattttttttctcttggaaaactaaaagacatggataaacagcagtaatcagtgataaacagaaaaaaacttttaatatataatgtgttatataacatgtatttcttaaactttgtaacttataaatattagaggatacagtgtattactattttttagagacagggtctctctgtcactctggctggaatgcagtggtacgatcatttttcactgtaacctcgaactacagggctcaagcagcccttcccacctcaccctcctgagtaactaggactgtaggcacataccaccacacctggctgatattttaaagttattttttgtagagacagggtctcactatattgcccaggctgctctcaaattcctggcctcaagtgatccttctgcctcagccacccaaagcactgggttgacagacctgagccactgcacctggcccagttacttttcaagtgtctgcaatatttataaagctatatatatacttgaccgtaaacataatagctaattcaaaacagcagaaactataaaagttgttgttgtgagtatactaaaacaaagatttttaaaatgacattaaaaaaataaattatgaaaataaggcattaatgaaaagccaaaagaaaacactgcatgcttttatgatttaaaaagatgaagaaccaagaatttagtataaaatttaagaaaaatagaagtagtatattaaagataaaggtaaaaattatttttaaattgtgtttatatagtggatactttgcagacattgaagtggattagataatttatgtatatgttgaaatgaaaacatgtcctcaaaacttaaaatcttaatgaaaaagcagattgcaaaataattgtatttacacacacacacacacacacacacacacacacacacacacactcttacatagatttatgtgtgcttataagtccctatagttgtataccaaatttttcataatgttcaggggttttcttcatcctgtagggaagcagctagattatggggtagacttttattttgtaatctcttgtggttttaatttttgttttttacagtgagtattgcatattttctataattggaaataaaaaagatatgttcattttgagggggggaagcaatatttcaccatacgaaactagaaaaaatagtttattacgcattgcatgcctgtatcaaaatatttcatataccccataaatatatacacctgtatacccacaaaaattaaaaataaagattttttaaaaataggaaaaaaggtggaattaataaataaaccttaaaagaaaaaggcttatgaaagaggcaaaatatataagcttcttgcagatctgattaaacaaaatcaaccatagaaagtagatttaaatcacatagaagaaatatatgtatataaatattaggagcaatacatttacacagttatatgttaataaatttcagaaacctctatgaagtttccagatatattaaacattccaaatgtttttttctacatgtatatgcagtgaaaataatgtataaaatgtgatatactgataacttgacaatattatcaaagaactactttttaaaaaaagaaaaactctgggtttgatacatttgctggtaaattcttcagaactttttttgaggaataaacaatttctgtatactacaaaatgttctcagttattaaaaagtaagcaggccaaagaggaatacaaagaaacaaaggtaacacttaaaaaaaaaaaaaaaaagctatcattcagtttcactttttgaatatagttgtgttccttaaaatattaactggtagaatttatcagaatattggaggaataataagatttaaattaggctaagtctactggactaaaaccttgatagagatatatatcctctatccagaagtcataaatagttcagtattaagaaatatattaattcatcagatgtaataatagctaacatttattgactgcttactttgggttaggtaggcactgttataagcggttttatatttttatttagttatcaaaataattctaaggtttctctagggttatattacctagatgaagaaattgaagcatggaaatgtcagacagtgtgcccaaggtcacacaattactgaatgacagaactggggtaagcacgcggacttctgactccaagaatccattagcttatttggagtttaaatagaaactttaaaaggtttcataaaattaaatgcccattaataatttttttaaaaagaagtagaaaaagtgttctttaacattatagggaatctttatagtcaacagacagctttatatttatttattgaaaaattatagatgtatatatttatggggcacagagtgatgttacgatcttcgactaccatgtgaaatgcttaaatcaactaatgtatcaagctgatatgttaatcaatttccacaactattttacattttttaggtgatgagaacatttgaaatttactcttagcaattttaaaatgttactagctatgttcactgtgttgtgcaataagatcttattaaaaaaaaaacttatttctcctatcttctaaccatatctggtaaccaccattctactctttgtttctatgagtttgattgttttagattccacatataagtgagagcatgcagtatttgtctttctgtatttggctaatttcacttaataagcatagtattgtctaattccattcatgtttgtcacaaatgacagaatctctctctgttttaaggctgaatgcttttccattatgtatacttatttaggaccacattttctttatccattcatctgttgatgaacacttaggttgattccgtacttggtattttgaatagtgctgcaatgaacatgggagtgtagacatctctttgacatactgttttcgaatcttttgggtaaatacctagaagtgggattgctgggtatttatttattagtttaaaaaaaaaatcctaggctgggcgtggtggctcatacctgtaatcccagcactttgggaagccaaggcaagtggattgtctgagttcaggagtttgagaccagcctgggcaatgtggcaaaacctcctctaaaaaaaaaaaaaaagaaaagaaaagaaaaaaagaaagaagaaccctagaggtagttactaataatggaggtgcatcagaattattcccagtgggggctaaactcccagacatgtatgttttgaagcagctttgtgggtgattgttaaaaactacagtgttggccgggcatggtggctcacacctgtaatcccagcactttgggaggctgaggcgggcggatcacgaggtcaggagattgagatcatccttgctaacacggtgatactccgtctctactaaaaatacaaaaaatcagggcgtggtggccctcacctgtagtctcagctactcgggaggctgaggcaggagaatcacttgaacctgggaggtggaggttgcagtgagccgagatggcaccactgcactccagcctgggtgacagagtgagactctgtctctaaaaaaaaaaggaaactacaatgttaaaggtacatcaaattttacagcaaagaagtcaccctggaagatctacaaatattcttgtaaaagttctggcctatacaataagacatgaattagaactagaggtataaatgttagaaaggaaaattaaatttttccttacttatggttaagggaaggtttatctgcaaatcctaaggaattggctataaaactagggttaagttcaatttgagtggcaaaatagagcttagaagaacaaaaaccgaaattatgtaataaccactttgaataacaaccaaagtgagagtccacgcaaaatataaatattaaaaagttagaaatactcatttttgctcagttttatcttttgaatttgatttaaacgtaaaaattaactagaaaactattaaaattcttcctatttcttatcccattctctgtctctcataggtaatcatttttaattaatttcagtttatccttctggttttcttttcttttctttttttttttccgaaaaaagccagtagctttatgtattattacttcctctcttacacagaaagtagtagcatactgtatttttttaatattgtcgttgtcactttaatgatgtatcttagagagatcactcccataccaacacatagaaatcatcttcattctttctttggttttagggtattctatgaatgtttattcaatcattcttctattggtaggtattttactaagaatgacattaatgggaacagtgtaactaatctatgatagaaataaaaccttgaagatatgaataaatggacacaggtgcaatagtccaagacaggaaggttaaagatgtaaatatatcagctctcaaaataattcataggtttattgtaattctattcaaaatactattgagctttaaaaatcataacaaaaagatttggaaattcatctagatgaattaaaaaaaatggatagagaaaaacctaactataagataatgaaacagtgaagctataacaaaaaatagagtaccagcaccaggataaaaaagataattgggaacgtggtccagaatgaaacatacaggacataaggatttaatatatgataaaagaagcacacatatccatagggaagggaaagtttatttaacaaatggtgttagtgtaacagtaagcaatttggagtactgaaatttagatttttatttttattttttatttttttttttgtttttttaatttaattttattttattttatttatttattttttttaattgatcattcttgggtgtttctcgcagagggggagttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgattcttaacgagcatgctgccttcaagtatctgtttaacaaagcacatcttgcaccgcccttaatccatttaaccctgagtggacacagcacatgtttcagagagcacagggttgggggtaaggtcacggatcaacaggatcccaaggcagaagaatttttcttggtacagaacagaatgaaaagtctcccatgtctacttctttctacacagacacggcaaccatccgatttcccaatcttttccccacctttcccccctttctattccacaaaaccgccattgtcatcatggcccgttctcaatgagctgttgggtacacctcccagacggggtggtggccgggcagaggggctcctcacatcccagtaggggcggccgggcagaggcgcccctcatctcccagacgaggcggctggccgggcggggggctgacccccccacctccctcccagacagggcggctggccgggcagaggggctcctcaccacccagtaggagcggctgggcagaggcgcccctcacctcccggacggggcggctggccgggcggggggctgaccccccccactgccctcccggacggggcggctggccgggcagaggggatcctcacttcccagtaggggcggccgggcagaggcgccccccaccccccagacggggcggctggccgggcggggggctaaccccccccacctccctcccggacggggcggctggccgggcggggggatgacccccccacctccctcccggaaggggtggctggccgggcgggggctgacccccccacctccctcccggacggggcggctggccgggcagaggggctcctcacttcccagtaggggcggctgggcagaggcccccctcacctcccggatggggcggctggccgggcggggggctgacccccccaccgccctcccggacggggcggctggccgggcagaggggctccccacctcccagcaggggtggctgggcagaggcgccccccaccccccggacggggcggccggccgggggggctaaccccccccacctccctcccggacggggcggctggccgggcagaggggctcctcacttcccagtaggggcggccgggcagaggcgcccctcacctcccggacggggtggctggccgggcggggggctgacccccccacctccctcccggacggggcggctggcctggcgggggctgacccccccacctccctcccggacggggtggctggccgggcggggggctgacccccccacctccctcccggaaggggtggctggccgggcgggggctgacccccccacctccctcccggacggggcggctggccgggcagagaggctcctcacttcccagtaggggcggctgggcagaggcccccctcacctcccggatggggcggctggccgggcggggggctgacccccacaccgccctcccagacggggcggctggccgggcagaggggctccccacctcccagcaggggtggctgggcagaggcgccccccaccccccggacggggcggctggccggggggggctaaccccccccacctccctcccggacggggcggctggccgggcagaggggctcctcacttcccagtaggggtgaacgggcagaggcgcccctcacctcccggacggggtggctggccgggcggggggctgacccccccacctccctcccggacggggtggctggcctggcgggggctgacccccacctccctcccggacggggtggctgccgggcggagacgctcctcacttcccagacagggtggctgccgggcgtaggggctcctcacttctcagacggggcggctgccgggcggaggggctcctcacttctcagacggggcagttgccaggcggagggtctcctcacttctcagatggggcggccgggcagagatgctcctcacctcccagacggggtcgcggccggatgctctcacatcccagacggggccgcggggcagaggcgctccccacatctcaggcgatgggcggccgggcagagacgctccttacttcctagatgggatggtggccgggaagaggtgctcctcacttcctagatgggatggcggccgggcagagacgctcctcacttcccagacgggatggcggccgggaagaggcactcctcactttccagactgggcagccaggcagaggggctcctcacgtcccagacgatgggtggccaggcagagatgctcctcacttcccagaaggggtggcggccgggcagaggctgcaatctcggcactttgggaggccaaggcaggcggctgggaggtggaggttgtagcgagccgaggtcacgccactgcactccagcctgggcaccattgagcactgagtgaaccagactccgtctgcaatcccggcgcctcgggaggccgaggctggcggatcactcgcggttaggagctggagaccagcccggccaacacagcgaaaccccgtctccaccaaaaaagtaagaaaaccagtcaggcgtggtggcgcgctacaggcactcggcaggctgaggcaggagaatcaggcagggaggttgcagtgagccgagatggcagcagtacagtccagcttcggctcggcatcagagggagaccgtggaaagagctgaaatttagatttttaaaatatgaactaaaattccagatatattaaataattacatagaaacaataagccaaaaaattaattgtgtatttattgaatttatgcaaaggaacagctaagttcagaattagcagaagaatttaaaaggagattgttgacagattggaccacataaaaatcttttatatcatctaaaaatatagcccaaatgaaatttaaaaaattgtagcagactggaggaaatatttgtagcaaatttccagggttttaatattcttgtatatgaaacccttatgcaaatacataaataggcataggacaaggctggacaattagttaaataggaaattcagcaaataacaaaacatggaaatattttagatgtgaattaaacttctcaagagttaccaggatccattcattaaattagcagcaactcccatgctggccagagtgtaatcactagatgcataaattgctgatggtcttatatgtaaaacaaccatttgaaaagcactcttgcgatgtgtcaggattcataaaaatcttcatactttttgaccctgaaatctcacacctgggaattgatccaaataaaataataacctgccccccttccaaaaaacaaacctttaagcccaaagatatccacagagttatttcaaatagtgaaaaattagaaataacctaaatgactaatcaggggagtaattaaaatgttcatatgtcccctgagagaatacagtaattaaaaatggtaatagagactgcaattgaaaatgtaataagggtaatttttttaaagcaagctttcatattgtatctatagtttgatatgagaatgactggaaggaaatagataaaagtcataagcagttacaataagaggataataggtaattcttttccgattttctgtgatccagtgtaatgcaaggctgcactggtaggagtacagcaccgagatcaagagagctaataaacctatgttatgagaggaacacggactttggaggcaggagatgtacagattgagttccagttctgagttttctacttacaaatttgaaggcttgacaagttagtaattactctgaacctcaatttcttcatctgaaaaatggtctgataacattgtcttcatgattattgtatggattaactactagaaagtagttaatgaaagtagtgttctactgacatcacatctggaagaatatatcaatcaacttagaagcaaccttagatctcaatggctaacaactattagaaacaactaaagaagatttgggcatgtaatcccaggactttgggaggccaaggtgggaggattcttgaggccaggcattccagttcagcctgggcaacacagcaatacctcatctctacaaaataaaaaataaaaaaaattagtcgggcatggtggcacccactattgtagtgccagctactgtagagactgaggcaggaggattgcttgagcacaggagtttgaggctgcagtgagctatgatcatgccactgcactctagcgtgggaacagggcaagaccctgtctctaaaaaagaaagaaaaaataaccaaagaaataaagcttctttcccacttatgttatttaactagctgtagactgtgactctgctatatgttttgtttgctctgggatcaaggcagaggggaaacaaagacagtaaagccttaggtgcctcttgaactgcttgaaagtggtacactaccactcctatttcattgaccaagggtaatgtccatggccctgaacattatcctcccattgggataggccaatacagaagggcaacacatattttgaacaaatgatatgtgctgtgacagtgctgtccagttctgtcactttatttatttatttatgaatgaatgaatgagacggagtttcactcttgttgcccaggctggagtgcagtgcggcgatctcggctcactgcaacctctgcctcccaggttcaaactattctcctgcctcagcctcccaggtagctgggattacaggcgcatgccaccacacctggctaatgtttgtatttttggtagagacagggtttcaccatgttggcctggctggtcttgaactcctgacctcagatgatctgcccgcctcagtctcccaaagtgctgggattacaggcgtgagccaccatgcccagccagttctgtcactttaataagggtgtaacaacctggggtacgtctggaggaggaagatttggacagtgagtaattctgaaatctttactaaaatacagtgggaagagtcattggaaagggaggggcatattaagtctcttcaaatatttgaagaatggctgtcactggatggtgagattagttcagtgctgtgtggcatcagtgggtggaagttacggcctcatatattttgactcagtatagtggtaaggagaaaagtgagaagaaaaggaaattattggttgttttcaatatgttactcatttacattcttcaaaataatcctaacagagcgtgtatgtttctgtgtttaaatattggaagaaagactcagagtgaatgaatacccaaggtcacatggcacgtaagtggcaaaaccggtttggaatccaggtctgtgtaatcttgtccctttctacaatattctactactctctgttgggctgcaagcatttttacaattaaactgttcatcaccagtcatcatctgcctgacaaagtaaaggccacatctcacacatgtctaaaagggttcaaacagagaatgaatggaaaggttgaaaggaaggttgaactctagatcaatgatctgcaaacttatttgatcataagtacctcttagcaaagtacttgtacatactatatatgtagcttatacataaactattgtactcatatgttgtaaagcatataggacattcccagtacaaagaaatggtaaacatttgggatgatgtgtgtgctaattcccttgatctgatcgctatatactgtatgtgtcaaaacatcaccgtgaaccccattaatatgtataattattatttgtcagttaatttttttaacctataggaaaaataagagtttaaaaagattaagattttatataacattttagtttttttataaattagatttcaggttttatgtaaaatctcatctttataaaactttgttttgcagatagatacttttttctgtatccctgtggattgtcttttgtacccatggaaatgtatacccccaacattggaggtcattgttttggatgattttgtaagactcatttcagtatgaagattctgtaattctttttgtccagaatttttttgaaagggctaatggtagcttacttcactttcagaaaggtttttaaatagttttatctaaaaccaaaactatagacttcactgtcatttgtaacagcaattaagcccaaaaactacaaagtgtgaaaggtgctattctagataaacagtagcaaccccatgagcattacaatgtatatataaatggagatggaagtgtaggggctattattaagtaagaaacctgatttttatttgtgacataagaaatagccttgttattttagttatatcttctctttctaaacctatatatatccaaaacttactgtagtcatatattctaaaatgcatctgaaattttgcctagagagtaatatgaatttttggacttgagaaattattttagcactttttaaaaatagagccaacgatttaaattaggctaagtctactggactaaaatcttgatagagatacatcctctaagaagcaaagaagttagttacttgcattgcctgacagagggaaatgttagctggttttctacattctgggccttagttattggcattgccaggttgatgtttcacaattaagacaactttttctgttagtgactgctccttggtgatagattctttaagaaaaagccatcctagaacacataaagcagaaagcaaacctagccttttaaagatactgttaatgttgagatagaattctagatcaacaagtgctcttttctatttctttctcttaatgatacgtttggtatcgactttttgcgtgacatattgcagtttggttggaagttgtaaaggaagtgtttcttgcaagtatgatcaaactcagtttaagcaagagattgaaacagccaacttcagctgcttattcagcacaggccttaagtgccccagaagccgatagtttcttaataataactcttagtgatcattttcttctagaaaattaccctggaaaagtagtataaatagtttaatctgctatttcttaaaattttgtattcctttactcattcaacaaataaatagtattcagtgcttctttgtgccaagcactgagggctcattagtgagcaaaagggatattaaccactgttttaaaaaaaaaatgtatctaacatgtactaaaagccaatggatgtggtgatgcatgcctatagtcctacctacttagaagggtgaggcaggaggatcactttgagcccaggggtttgagtttgtgctataatggtgccactgtactccagcctgggcaacagagcaagaccctgtctcttaaaaaagcaaacaaaaagcctttaatggaactattgttgctcataacggcatactttagaacccctggtctagtctgactgtgcttacctacctgcttgcatgcgtttctctttcttcccacctctcttcccctcccttccttcctttcttaattctcttctgttttttacaactcttttccttctttgagttagtgacaataagcaaattttgaactcatctaagattaggagaaaaactgtatgtgatatttattgtataaaacttgcatggtagagttaaacaggagatgataaaattcttaatttactttataaaccaaatgtcatctcacctgtctagctctcaaggtgggtatgtttgttacttcttccagaaaccatgtctctttaaatgggtttatatcattctattttaaataaaattcgtatgtttttatacaagtgtgctctttagatgcaaacatttatatgattagataaattttccttagtctttctttgattatgtattgtctgaatttgaatcctgatgtgttattctggaattagccatttttgtttctatttctgtttgttatgttacaattagtgtatttcttatttttcagtgctttaattgccttgttatctaaactctagaatatataccagttaattaaagacatgtgtgttttttttttttgcttttgtctttactggcgaatttaaaggtaattgaaagtataattcttgtcttctttagcatcagacaacagtcagcgctttcgagaaacctgttttgcatttgccttgacaccacaacaagtgcagcaaatcagtagttccatgtaagttgtcgtcaagtgtaacttgaagtttgacctttgaatccagtagtctataataaatgattttaaaaaacagtgattggtgagttagtatttgtgtgatgcaaatattagtaatgaaagtatagtgtgttagttactgtaagaacagttatatttatgataatttgaaaaacttttctggagtaacaaggtctttgaatgaactttcatgcaaatactttaaaagtaattgtaattcctattctgtctcttctagggatatttctgggaccaaatgtgacttcacagtacaggtccagttaaggtacagtgctgactataggatatattcaaagtttaaaagataatattccttttcacagtacgggtccagttaaggtacagtgctgactgtaggatatattcaaagtttaaaagataatattccttatcaggaaggggaaatggaaaaaaaattttaaggaataagaggaaatctacctgatttttcaataagtgtattgaaaatattaggtttagatatttgggtgagggaaaacattctcctgttatgagatattctaattttcatccaatttagatttttcccctgcccgcccaccccccagtttagatttcaatatagcaagtcatgttctatatatctaaccatatttgattgccctcagttggttgagaagctccagctaatgatatcttacaatatcatatcaagttttatgaaagcatgggccttatctccataagaggcaaagtactgtggataaggaattagtacttaagtctacagtatgtcatggactaacaaacatcaaaatattctaatttgttttgttctgtattttaaataatttaaatatgctctaatttaggatccatttgagacatctcttaaaaatgttcaaagactaatgggaaattttccaacatggattcacaaccccttattgagtttcttttcttagcccattcatttgtcttagaatatctaagaaatattttgtattatttctctcccttatatatctcccttttatatacatatatatatatatctcccttatataaaccatcatattatgctttattattcgatttaccaacttaaatgtccacactgttggaatagggatggaagagaaaatataagacagttgttttcctcagtaagctgttttccctataattgtcaggaggataaatcaaacagttagccttgtctcaataatcagatactaagttgtatgtacaagttacaaatacactaggaggctaaaaaagggattaatctaaaacgcctgttcagcacttcatggaaccatgtgaaaacctctcatctaagctttgaaataataaggtaaaaacagtgagaaagcagagttgaagtcgaaagttgagttgaagattctaaagaggatatgactatacttaataacttttataccataaaacagtatgacaggaccttactgcagtagactagtgataatctaagtttcagttttggaaggcactgctaaagatgattctgtataaaaggtatattttatgtcggccagattgtgataatgactgaagaaattaaaggacaaaaataagatgtctccatagttaattatgtattgctgtagtcttctttacttcctgcctcaacagtttacattttgcttgtgctgatacttgacattatcctttaaatcagtggttttcaaacttgttgcatggagccacccttaggggttcatactcttctgccatcctcctcttctctcctaaacacatacacagtctgaaccaaagtggggcttcttttatctcttttatctgttttgcatgtttgactctgggttaatttttgcttaaagacagggtcccaagactaaaataaagtttaaaaaccgtagctttagaataaaagatctagttactaagtattttgtattaatatacatacattctttaaagcagcaacaggtgtggtccacattttgaagtaaggttgtctagatagatgagctataattcagagattccaagggtatcttgatgactgctattttaattgaaatgtatctccaggacttggaaaaaaaaaaaaaaaaagaaccatgttgtgttatatttggtaattgttaggtggttctttgtgttttaataaaacagttcatctctctccctgccccacgttgctaggtctgcaaccatagtgtattatttaagttaggagtgtatgcctatctgctatcctaattagaaatgtttatctaaagcataaaaataattagttgagaattaggatccaagttttctttattagacacctagtctgttttcatttatgttgtgcctccctgctccactccctcctctctgccccatgaaccacttcacagaaactttctgctattcctttttttcttttttctcttcagttcattagggtgatttagattagttgaatagacactgtcttgtcatttaaattactcttttcctataggaaagggttcaggcagccagggtccatgttttaaattgatcactgcattggaataattatttaaaaactgtgacatccttttaactattgcagcctaaagaattagcctgtaatggaaggttctgctggggttaggagtggtcctgtgagctttgacatctgtttgctaagtatatttctagaaaatctttgtagatcagtaaatcttaacttttttatggatccctgatccctttgagaatttgatagaagctgtgaatggtttccctataaaactgaacatgtatatgtactcaaaataatttacatataaaattgttttatattgtgcacgatccccgtactcagatttcatggccagcaggttaagaccccataccgcaggtgttgagaggagttgttggcacatgaggaatatttcacagatttcggagatagggttctccctactatgtaactcaggggtgctattagcattctataacagtgcaatgagccttaggtgtatattgagaataggtactaataaagaataaatgccttaaatagcaaaatagtaataagagtgaatagactgagaatttatgaattatgtatctttccttgatttttccaaaagactgcatttaatttagaaatatttttataagtttctaaaatagtattctaaatttatgtggctataacacaaataatattcaatatcttcagttctcaaaaaataaggagtactttggcttactgatcctggggatggacttaaaagcattctcagtattttctgctaagaaccagaaaagtgtttcataggcaaataaatttggaaaatactgcatacaggtggtaggtcttcctcttagagatttataatgcttattagcctattaaaagctctgaaaagttctgtattaaggaagcttaatttaattgttttgattcagaatttcttaattttatttgactaacgagtctttttttcttttaacatctgttaatcactgaagaaactagtgcttctcagaacatgcttaaccaaataattggcagtatcacgaagacaactacagggtgatagtcatgattaccacaactctacattgacagaattatttattttaaacctatttacatatacttattaatagggtgaaaagtccagtttttatagttttcccttttggttgtttttaaatttaccatcttttaaatttatctatttaacaataatactaatgaagtcatcctttaataaaggaaattaaacttgtcctttattgtttaggttttgtttatcagaaaccagttgtccacaagaagatcacttcccacccaatctttgtgtgaaagtgaatacaaaaccttgcagccttccagtaagtcctaagagctgttttttaaaattcattgccaacataactatcaaataagtcatcacaactgttgttaaatcatagtttttccttaagaaaacatttttattttggatatatattcattgactgggtgaaacacttgtaccaactatgtacagttagcagcagtgacattagctttggggacataggatttggagttgggtatggtagctttagtgttgtactggattttggggcgaagttttttcaacaaaatctcagctgtgttcatgtgagtctataagcctatggtagaatggagatttgaagaatgctatgtcttaaacaggaggtaagggtgaggactgtttttggtgcccttgaaatactactactcatgtacctatctaagcttgttatgaattcatcctgatttttaaatttaagagattttgaattttcatcactaatagttttctcaggtttactataaggagagtataaggttgtttggaaaaataataacacaagaaacttgtaaatgtttgcttctctactttttaatgaaaacattcatattttctagtatgcagtttgtagggggttttttcttaaggaatggaagtcaaaatgattgtggaaataataagtataaataaattacatttcatttttagggttaccttccacctacaaaaaatggcgtggaaccaaagcgacccagccgaccaattaatatcacctcacttgtccgactgtccacaacagtaccaaacacgattgttgtttcttggactgcagaaattggaagagtaagtaaatttttgtttctaccagatttttgtattataaggaggggttaatcaccatgcctatctgaatttatatgtaaattatgtaaaatgagctgcaaaaggatttatttttgtctcacaatgaattttcaacatgtttccatttgaaaaatgggattatgaagtatccagtgttttataacctggcccttttactccacaattgatcataaatgtcctcctgtatcatcacatgttcttctgcattattttaagtgatgatatcatattccaatatgagtatgccataaatttgcctgttccctactattgagcgtgttacttgatttattgattgattcattggtatgtcaaagaacattttgaagaccatcttagtagctataactttgcatgcatatgataatttccttagggtaaattctcagaagtgggattgctgagtcaaagagcctacagaattttaagaaattttgtgtacattgacagattaccttctccaaaggtgttgtacaaatttattctctgactttcagtgttatttgcgtgctcgttaacactattatcttctttgaaatttttaccaattctgttaggtaaataatgccaccactgtgttttaattagtacttttttcattattactgagattgaatatgttttatatttgtgattacattttaaaactgtatccgtgtctgtttctctattgctgtttttgttattgattatgagatcttcatatagtaaaacttaactctgtttcatgttacaaatatttgtttccagtttgttggccttttatttttatgttatttaatatgcagaatattattaatattatttatattggctacacaaagttttcgtatagccaaaacttaaccagttatttcctttatatagtcttttctcgtctccatcatgctttgcctatctgcccttcccaagctatggaattatttgtttattttcttctagacttccaaggtttcatattttacctttaaatatttagttcatattaaatatatgtgtgatgtgaggtaaaaattgctttctttcactttttaaatagctggttctaacactgttaactaaataaatgttgattctgaagccaccattgttatatatttaacttttacatatcctgagtgtgtttctgatctttttctatgttgtttcttagtctaacattcttttttgggacaattttcatgatatgaactcatatgtatccaccagttcatttgaaatttattgaatgcttaccatgtgtcatctactatactcaaaactggcagtaccatagggagggaaaaaagttcattttcatgaggcctgtgatgtaggggcctggtggacacatacaaagaatgtgaacttacttataagtactataaaagagaagcacatggtgattttacagtgtatcaaagggcactttgaacgagagagagcagtcagggagggcttccctgaggaagcagtgactgagccaagagctgagaaaagagttgcaatcaggtgaaaggttcagaggaaactacccacacaacagcccagtggtaggagtgagcctggtttttacaagaagctgagagggattcactgactagagtgcagagaatggggaagagtggtatatgagatgtggctagaggggtaagataggactaaaccattcagggcattgtaggtaatgttaaagttaaggattttctttttctttttctttttttgagacagagtctcactcttggccaggctggagtacagtggcacaatctcggctcattgtaacctccatcccctgggttcaagcgattctcctgccacagcctcccgagtagctgggattacaggcacctgccactgcacctggctaatttttgtatttttagtagagatggggtttcaccatcttggccaggctggtcttgaactcctgaccttgtgatccacctgccgtggcctccccaagtgtgggattacaggcatgagccactgtgcctggccaggattttctctttttaagcagaaagtttatagtgctgtatttctttttagaaaagatcactccttggagtggtaaatagtttaaatggaggccagaatcgtgcagaaggacatctcttaggagccagctcttgtggaagtattagtgaaatggtatctttgtctagagtggtggcgatagaaatggaggtaagtaggggcatctgcaggattgagtgatgaattgaaagtcgagggctaagagaaagggagatgtgactgatgagtccttggtttctgggtggggggctaggcaaatgatattgctgctgagatagaggaaacactggaaaaggactgagtgtgggtgtgttttgttttgtttttgttttgttttgttttactttgaagaatgggcattggaggacaagatggagaaaattatgaatttacttttgaaacttttgagtttgaaatgcctgtgagacatcctgaataggcagtggggcagataggcttaaaggatacatttgggctagagggaaaaaatgtgtgagtcatctgcatattggtggttattggaaccacactggcagggctgacattgattctcctgcattactttttttttttttttttttaaacattctttcttccagataaagtagaattactttatcatatttcttttcctcgctcctgtaccccatttgcacatctttctgagaatttggatgagatttctttaaagttatagattaagttagggagaatttatttacaatatttaatataaccattctaggaactgtattttcaaatcttcttttatgttcctcagcaatttaatgggtttcctacaattcctgcatattttttgctaattcccatgttggttgttattattactgctattataaaaagagatctttttttctgttatattttcaaagtatttattgttggtttacttaaaaactagttatttttaatatttatttcatagctaaattcatatattggttctattagctttttagatgatttattggtatttctatgttgacagttttgagttttaggtatgtcatataaattatattaccctaatacttttgtcatttatttcttgttctactacctagaactttgtaaacagcgttaaacaatgcaggcactagtggacatatttgacttgctccttatgttaatgagaatactgctactgttataacattattataatgttgctattaattttgatagaatattatatcaatgatgtatttctatatttctcttactggatttttttttagaaatggattttgaattatatcaaaattctttttgacatctctcagggttatatttttttcctttaactcatatgtcaccattaggtttttaaaatccttttaaatattttatttctagtgtaccttggagttccctttttcctcctttttggggaaagttttgaaaatgttttgtttttgtgtatgaaaagaatagctcaccaaggaagaaggggagtgtttttggtgaaataggaaagaagtctgaaactgtaggagaggaggggaatatggccgctgataaaaagcactagaggaggggggaaatactcttccataggaaggcttccagctacaaagatttgaagacatttttctggggaagtaaaacactaaatcagcattattttccaaagcccagaaaataacttaatagattgtttttaaattactgttttaattcagcttgtgaagatattctgaatagttcatgtagaatatcttactattttgcagatacttttgtataaatagttgccagtgagaaatgttgcaactgtgtcttttcaaatgaagtaaataggagagctagtatagcgcctgaaagaagtaagtgagttatattgtaacttcttgctctacctcagggtaagcactccttttagcatttattaaactctcattatttgtagagaaattatttagatgtaggttgagtattcctaatctgaaaatctgaaacacaagatgctctaaaattcaaaacaggatgctcaaaggagatacttgtttgagcatttcagacttcagattttcagattagggatgctgaactggtaagtataatgcagatattccaaaatctggaagaaaaaaaaaattcagagtccaaaatacttatagtcccaagcatttcggatcagggatactcaacttgtactagtgtaaggggcacataatgaatagagtatatttcaattacagagaaattatctcatgaacttgacaaataatttttaagacttttgaaaaagcaataaacaaaactatcagtataatataatataatatagtataatatatatcagtagttggaattagtatttgaaggattagcaggaacaataaaatactgtctacctagaaaagaatctctgtcactattaagctttggtggggttttttttgctgctgaacctctttcatatgatgtaaaaatttcattttatattaccagtacaagtggcatttgttagtaccacattctttttgctgcttttattttatttttctatttgcttacatgtttcaactagagtgagcataccttttcactgaacttgttgcagtttctgcttgatctcttcttaaatatttatataaagccttagggtaattccaagttctgaagattcaagttgtcaatacatagtttcacattgttaattagcatttctccagtttctgtcatacttgaagcattaagcaagtaaataataatggtgaataagatttttttctaaaagaagctttccagttgggcctggtgactcatgcctgtaatccaagcactttgggaggctgaggcaggcggatcacttgaggtcaggagttcaagaccagcctagccaacatggtgaaaccccatctctactaaaaacaaaaaaaacaaaaaaacaaaacacacacacacacacacacacacaaattagctagatatggtggtgcacacttgtagtcccagttacttgggatgctgaggcaggagaatcacttgaacccgggaggtggaggttgcagggagccgagattgcgccactgcactccggcctgggtgacagagcgagactctgtctcaaattaaataaataaataaacaaataaagcttgtcaatgctatatcagattagtatgttgtatgctctaaaatttaggaatttttttttttttttttttttggggggggagacagagtcttgctctgtcacccaggctggagtgcagtggcgccatcttggctcactgcaagctctgcctcccaggctcacgccattctcctgccccaggctcccaagtagctgggactacaggcacgtgctaccacacccggctagttttttgtatttttagtagagacggggttttaccacgttagccaggatggtcccgatctcctgacctcgtgacctacccacctcagcctcccaaagtgctgggattacagtcatgagcccctgctcccggctgggaaagttttaatgttacttgttcctcattaatgtgaaatttattaatgaaggtaaattcgcttttttgacacttctttttcctccctctcagaaaatgtgtagcatgtaaacacagatagctttccgaactttaaataaaaatatgaccttccagagagtattgtagtatattttctgtcaaaagaggggagtgcattaagttccatgtcttaatattcccaccctttccctttggtttctagtgtctgctctgtcatcaagcagttgcctaatcatgagcagattgcataatctttttgtgcctcagtttcatcagcccttcacttagaaaaatacctatcctacctgtgtcttaataggccttgtgcaaagtttaaatgaagtaggcagcgtatgttaagaatgctttgaaaaatgtgtgtagctataaaatacaagatggcagcaattatttttccttttacttcttttcaagtctcttgatcttcctcttgatcccagcaccaaatagaaactgatccttctcatttagatctccttcctacccttcgtgaacctcagccgtcttttctttctcttacccaaccatgtacccttcacttagtcttagcttgttgattaactgtttttttttggttttggcttttctttttttttttttttttggtccccttctacctctgtcatctctgggtagtctgtctgctggtaatggatattcatctgttcatttgccaaaccagcagcttctgtttgaaaaccttctttaatattccctctgcttgttgtgataatggcccaagtataatcttttcaagagctacttgaaggcatagagaaaggttaaaaggtataaattaggaagcccatctcatttgtcatttaaaaaaaatagatactattttagatatatctgttacctactaaatatggtttatagctttgacatcttattgtctttggcttatacttagtcttaacagtattctttcatgtaagtgccttaaattcattagcttcaagtataggtaatattaaatccaagacagacctgggtttaaattctaggtttgttacttgaaaattgcaaaattagggcaagttcttttacttctctgtacttcagtatcctcatccataaaaacaggtttatgatcatctcggcagctttttggtcaggattaaatgaattactgttcatgaaaacacctaagactgcttgacacacagtaggtgttttaagaagtgttagttttctttccctatcatggtgagattaaaatagatgtactatttacttacatatgttgtttgttttctacttctttttttttccagaactattccatggcagtatatcttgtaaaacagttgtcctcaacagttcttcttcagaggttacgagcaaagggaataaggaatccggatcattctagagctttaagtacgtatgataaacttatttcacttattcagctattttgttaaaggttagagtagtattttctcaactcaagaaattttagaatttgtttattcactggagcctgttgtgtagttcttagagtagttctgatatctttgtcatgagctatattttataatctatattttactaatcttaaaattaactttgtgaagtcagtgcacaaacatggaagaatattattctacaacttcataaaatcaatgtttaaggaattctgggaaatgggaagggcatcttggcataaatttcaagaaagttattttagattggtggtttatccaggaaaaatgtacagaattatatcatggcctcaccccctgcatttacaaagtgaagagagccagtggggtggtagaaataataattctgccattaatcaattatatgactgtggacaagtaacgctgctcctgagtttcatcttcctcatctgtaacaagaagtttatgccgtctgatttctaatgcttctgcgaagtctgggttcatacgtgtgaattactggatggtttgttttgatacgttgaatttgagattcaaggtcttcaaatggggctgtgctgacctctgtttttaagggttaaggtcagagggtttggcctttccaaagaggtgaactaagttcttcgtttattcttttatttgtgagagccgggggctgcgtggatttaggagtgagggctggggacttagaaacaaaacttttataggcaggtgttagatagctatcctttaaggacttttgatgtgaactgattaatgaagcccattatcagatttgtacttaggaacactctggtggaaagaactaagataatagcagctttccttttgtagcatagctattacccctttctgtaacttatttctgtggcagagtaaaagatcccactacccctgaatatcaatatacccttaatagttcattgaagaatttttctgtattaaaatggtcctttaaaaatgcagctaatcctgaatcaatgggagcacactttggctaatgcctctgtaggcatgcattgacagatgatggagacctagaagggcagcactgatttgggatctgcgggagtggtggcaccatttggcagggataagaagatggtagggatcctgaaagaaaagacagacatctgccttgaaggagagtataagataacttgtcttctatcacaatcttgctgaagttattcctggtcattctactgagaatcttcgtatttgcctcacaatactagaatctcagccagtcagaaagcaaagaattatgtgagcctgtatggaagagggaataccaagaaataaggcagatgaagttattttatttaatagtaacagcaacaacaacaataaggccaactgtctttgctcaagctgttaactcttctccgcttgtagctatagcaccacctggagggagagtgggaacgtgagtctggaattgaattattttattttctccgagaaaccactattagctaccattaagcagcaaaaactgtttaattcaaaagctatttctagtctgatatactgatggatgtggagaataattgtacactggatgagatttttgtggaaattgataccttaccttacttattggccagggaagccaatggaatattaatttggatcccaccagtaagaaatttgttgtaatttactaaaaaacaggttatctacctttacctgtatgctgcctgtaaaaaaaaaaaaaaaaaaaaaaaccaaaaactttcccaacaaattatgtaattaaaattctgtttacaataacttgacaaaaggaaatgtcaggtattttaaaagagtcaaatcagttacaaatatgttctttgtaagtcattcttaataaaataagtacttctagcaaagttttagtagtcaagccagacactcttatgttcttgaaagaataaagttggtattatttagacttttcacagagaactccattctctgaatcatttgatttagtaggattttgtcttgcagtttctgcctttgtgtagagttgtcccctcacaactatgaaaaacagtcttttaccaactcttaatcaagtttctttctcctcttccttctcccttcagcagttatttcaagccttagccataatctaatcaaacactatccccctctctcagcactctgccaatgcatgaaaattggggctacaagacatgaattacctaaaccacccatttcttccttaatctcagtgccaccataattacttttttagcttatctacatttgtgcccagtcctcgctttattttgttcagtgtcaagaggaaatctccctttccctgcttattcatttattcttttcattcaagaaattgtgttaagagtctactgtgttccaggaacaggagaatataacattaaacaagacacataccatctctgcatcccccagaagtttgcagtctggtaagaaagacaggcattaaataattgcacaagtcattaatgagttaaagttttgacatgtgccttgaagaagatagacagggaactctgtagaggtacaataggggaacgtagtcctctctgatactgtgatacttaaggcaagattataagtatgaggagaagttaagctccaagatgggaacagagtatgccaggagaaaaggccagtgcagctggaatagagagagccaagaagggctgggtgcagtggctcacccttgtaatcccagcacattggaaggccgaggcgggtagatcacttgagtgaggtcaggagttcagaccagcctgaccaacatggtgaaaccctgtctctactaaaaatacaaaaaaattatcctggcatggtggcatgtgcctgtagtcccagctactcggaaggctgaggcacgagaatcgcttgaacccgggaggcagaagttgcagtgagctgagatcgcaccactgcactccagcttgggcaacagagagagacactgtctttaaaaaaaaaaaaaaaaaaagagagagagagagagagcgccaagaaggagggtgaccagagagttggacaggtataagttgacatagacgatatgaagatagatgatagaaaaccattaaaagatttttaagcagaggagtaaatgacacgattacatttagacaatctgattctcactttgaagacgaatcaaaggaaggcaaggctaatgcagtgaggccagttgagaacctgtttgtaatagtatacgtaagagatgataatgtcttgaactaaggtgatagtggtagatagaagttgacagttttgagaagcattgaaatggcattgactgtgtgtgtggagtgatgagtccaaggaggagtgctaagcttcttactcaagcactaggtaacatggtaatgccatttactgaaacagaaaactgtgttgaaaagatcagattgcaggggggagatcagagtggactgttagacttgtggtgtttgagatgggatgagacatccaggtagagatgcttggtaacagtattatgagacctggctccctcatatatctgctctttgtcctgtgttttcagttcctctctgtctgcaggctttttctgtcactctgtgctgtcaagactcttttatcttttaaaaaataggaaaacaagctcctctatggatagagctctgtgttcctcccattgttctcatccgaatttttgtgagagtagtctacacttgctctttttacctcctcactgcatctcattatggtctttaaccctctatcattccactgaaattgctctttcagatgtcacaaatgatgatctgattgctaaatttaaagtgtatattttcagttttcatcctgaatacttctgctgcatttgatatgaaccactttctccttgaaattctctcctttcttctctgaccatatcttctcaatcacctgccttcaatggattctcttaagggaagcattctaaatgtggctgttcttggagttttatcttgggtgcacttttctacgcacccttatggtttaaaactaacacccaccccaaaatacatgtcttcatctcagacctctcccctgcgtttcagacttatatagctaactaccttcacctaagcatttcactggttcctcaaattcaagtatttaaaactgaactcaccaactcctgtcaaacttactccctaaatatttctcaaatgtgccttctgtctatcatgctatcattgcccttgtttaagctctcatatcctgcttttattttaaaaaccattcttagataaaacatccctctccttgacgcctttttctatctcctctggtagcctcctaagtgatttatacagatctaaaatcttaccattctcattcccttgcatttcatggcttcttaacaccaagggaataaaaactccaagtatgttagcatgacacacaaactttccatcatgtggcacctgcttattactttccagggtcgcctgtattcactctgctttttaaactttccatgacgtggcacctgcttattactttccagggtcgcctgtatttactcttcttttcatacttcacattccattccaaaaatatggaactctttagtctttcttcagtgctttagttttgtgctctatgcctcaaaactcccctgctgccttctctgcctaatgtcattatcctttgtttcacttttttccaggagacatcccagaacccccaaaattgatgagttgacttttggttagcttcctgaacatactccatcagagtgcattagagatgatctcactgaacatctttaccctctactagattatgagttctttggaggaggaatttaatcttattttttttcttgaattcctattgctcagcacagtgccacatacatagtagatctgcatatttttgaagtaaactgatgaaaagacagctacagaaaaaaatcaggtcttggtgcctgtttctttgcttataaaatgaaatattgatcttaatatgtttgattgttttcggccttaaaattttaaaaggctgaattaaaataacctgatattaatgaaggatagaaattatcttgaaataataacaaccccagaacaccagtaatagaacaatctgtgataatggaagtgttctctatctgcactgtcccatatggtagccaccagcaacatgtggctattgagcacttaaaatgtggctagtttaacggatgagctgaatttttatttaaatttaaatacagcgtcatgtgagtagtggctaactcctgtagctcatgacaacagggattaaaaacaagattaattctgctccccaaatcgacttattgggtaaaacaagattaattttaaatgtgactagctgtaactttattatagtcatataataaaatactgttagcactgcagatcactgtaacaatgtgaaaactttaactcccagagaacttcccacatgttgactgattactgcaggacaaatattatatgtcttatttttattttttattcccttgctcacaagtaataagtgcttctacttttactttattttttcttcatactttcttatgattaaatatagcatagtgcttttcccctccgttttctctctttcttttgagaaagttttttaaagtataacttataggcaataaaaattcctttgacagatgtatacaatcatgaaccactgccacaatcaaaatatagaacatcctttaccccagaaagttcatctgtggccttttgcattccatcccatccttttaccattgatgtgatttctgctctgtagttttgtcttttccagaatgtcaggtaaatgcaatcctacaatatgtagccttttgcgtctggcttctttcacttagtataatgcttttgaagttcatccatgtagtttgttctttattgctgcgtagtatttcatttatgtactataatttatccatttgataaatgatggacatttatccatctgataaattgatggacatttggattatttccagttttgcagcaatatgaataaagctgctgtaaacatttacattttgcatatggatacctcagttttgtagacatatgttttcatttctcttgggtaaatacctaggagtgggattgctgggtcatatgataagtatatatggaaaacagtttggcaatttcttttaaagtaaatataccatttttgcattcccactaacaatgtgtgagatttcaagtggctccacatccttaccagcatatggtatcatcaggctgctttattgtagccatcgtgattggtatgtagtggtatttctttgtgcatttttctgatgtctaaggatgttaagcatcttctcaggtgcttatttgccattcttatagcttctttgatgaagtatctgccaaattttttgcccattttttaatgtcatgcttttgatatattatgaaatctttgcctaaatgaaagtcacaaacactctcttctatttttcttctagaaattttattgtttgagctcttggatctaggtctgtgattcattttgagttaatttttgtatatgcaaggtgagagtagagattcattttttcccccacatagatatcgaaatattccaacagcatttgttgaaaagactgtctttccttccatttcattaccttggcacctttatcaaaaaccaattgaccatagatgtataaatctatttccggacgttattcttttccattgacctgtatgtctatccttatgccaaacgagtcttaattaccgtagcttgatagtaagtcttgaaatcagttagaattctccaattttgtttttctttttcagaattgttttgaatgttgttaagtccagtaggtgaaacaatacatggtgaccaaacagaatttatttctgtaatacgaagttggtttcagcattcaaatgctgaaatataattcaccttctcaacaaactaaaaatgaaaaatcatatgatcatctccagagatgcagaaaaagcacttggccaaattcaacatccattcatgataaaactgtcagcaaaatcgagaagggagctgcctcagtgtaataaagagtatttacaaaaagtctacactacagctgatatcatcactaatggtctaaaacttgaatgcttcactcctaagattgagaacaaggcaaggatatctgcccctagcgttgccctagagatcctagacagcacaataagacaaggaaaagttttaaaaaagaaaccaacacacaggttagaaatgaagaaataattatagtctttatttacaaatgaccttatggtctgcatagaaaaagatcccaaagaatctccaaaaaagctactagaaatactatgtgagtttagcagagttagagaatgcatggtcaatatacaaaaacaaattgtatttctgttagtaatgaacaattggaaattgaaattcaaaaaagattttacagtaacatccaaaaatatgaaacacgtggggatacatcacacaaactatgtgcaagatttgtatgccgaaaactacaaagcatggttgagaaaaactgaaagaagacctgcataaacggagagatatatcttgctaagagattgaaagattctattgttgtatgtcagttctccaaattaatctgtagaattaatccagtctaatcaagatcccggtaggaccttaaaaaatatctttacaagaataaaaggactaggattgggtctgtaatggcaaaagagaaggcataggtttttttttttttttaatagaaattggcaaacattctaaaataatttcagaaaattctcccacctctgagagaaagtgaatatataaatcgtgttttattttaagtaacaatagctaatatttattgagaataatattaggctattttaaaactttttttgttgccagcatggtggctatgcccatattcccaatactttgggaggccaaagtgggcagataacctgaggttgggagtttgagaccagcctggccaatatggtgaaaccctgtctctgctaaatacaaaaattagctgagccatggtggtgcacacctctaatcccagctacttgggaggctgaggcaggagaatcacttgaacctgggatgcagaggctgcagtcaaccaagatctcaccactgactccagcctgggtgacagagtgagactctgtctcaaaaaaaatttttttttcttgtcgttgttgagacaggatctcactctgtcacccaggctggagtgcaatggcagcaatttcagctcactgcaacctctgcctcccaggctcaagtgtattttgaaactttttatgcatattaactcaatccttaaaacagttctgtgaggtactattattgttcccatttaccggatgatgtaacaggcatagagaggttaagtgatttaactgagactaaattctaagctaggctatccctaggtcctatgctcttaaccactactttatgttgcctctcttatttcaatttattttctaagcactaaacactgagctttgttttgtataaggttgatactatgatctataatattgcttcatttaagtggaaatttaaatatgcaaagttcaaagtcagttactatgcccattgcttgctatgtctataaagggtgctggtgggatggttggtgaaggcatgtagagtggttattagtcagggttctccggagaaactctaggaggggaaggagaggaagagaggaaaaggagagagagagatgagagagagtgagttaagaggagatgtattaggggaattggctcacatgactatgaaggctgagaatgcccacaatagataggccatcagcaagctggagaaccagcgaagccagtaatgtgactattgaagtccaggggccacagatccaggaagccaactctcaatctaaggccaaaggcctaagaggggtgaggagaagggctgatatggtggtacaaatcccagagtcccaagcccagagaacctggaattctttctttttaaagatggggtcttactgtgttgcccagactggtctcaaactcctggcctcaagcaatcctcctacctcaggctcccaagtagctgggatcacagaagtccaaaggcaggagaagaagggtatcccagctcaaggaaaaagagaaagtgaatttattttcctttcctctgcctttttgttctttccatgccctccagctgatttgatggtgtccgccaagattgagggcacatcttcctcactcatccacagactgacacaccagtctcctttggaaacacactcgcagacactttcagaaattatgccttgccagctatgtaggtagcccttcgtttagttagttgacacctaaaattagccaacacagtgagtaatcacattagaattctatttgcatgtttatttcatatggcgattatttgttgcctttaacaaagatactactttttaaaatcatatttataagaaaggattgactaagatttggtgtataatgacaaaggcatactttttgtaatttatatatggtattcattagcatagtgttacaactatattttccaaactaaaaaccagaagttgtatgccttttttgtgtgtcaggagacagcctgtgaaatatattaagactttgaaaatttggaatttccaggccatgaaatgactttttagtctggcattagaatcatatctggagcttttaaaaaactaccaattggtgtccctcttttcattctgattcaggaagctctgtaggtaggtctgatgtgcaccttacttgagatccactaatttatggaaatagttggataggatctccaggatttggaccatctaaaaaaatccagactaaaatccaggggactgtgtttaataaaggtaggatttctcataaatggttatcagaacagtagactctgaaattgtaacttacccgagtacttctccctctcttcgttttcttttctatatggtgtcttatctggtcacacttagttgtaccacagctcagaacttctgttgactgtgtatacagctacccaacttacggcccctttgtacaatatagactttaaagttattatgggacagtttctaaaattgttggaatattacatatatgtatttcctgtctcaccccctataatgttttttcttgttactgttattgaagttttcagaggtaacagctaaggtttccagatgagaagtataaagagtctttcatatcagactgaaagagaatgaaagaacagccttggaaaagtaaaattactagtgtctcctcccttaagaaccataagaagtttgaagtgaaaagacttaaagattatctagtgtgggttccaattttactacaagtaaaattaagctgagaaaggaggattgacttgcctaagagggcacaagtattttatagagaaatagattaaaattcaaataattgtatagttaaaaaaaagaaataggactcttttcataatttgaagtttgaattaagctgttttacagtaaatatttttattttctgagctttcaaaaatgtataaatgttattcttattattaatgtcctcgaaagtagaagagcccaagtaatattagtcatagtttaaaagaaagaaaaccttgatccaatatcttagagttataaaagaaaaagggtctaccattagttgaatatgtcaacatattagagaaatttctctcatattgctgcaggtttttgtcccctgagtgagaaataggaaatttataggaaacatagtcattctacagataaacaattgttttccatcctttgcttatagaattaaaagccatatggttgtttttatctttccattcaattgattgggaaataattgaacagatttgtttaagctttttattctttatagtaatgctccagtaatgtatctttaataaaactctgtttgctttttttcttcttcttcaatgaatatcagttaaagagaagttgactgcggatccagacagtgaaatagctacaaccagcctaagggtttctctactatgtccagtaagtgttaactattacttgctttccagaaagtttaacatacattttctctttttattaagtatttttactatttgagaaattctgtttgcttctaaaatatgtccaccattgttacagtttatgaaaagtggaaagacatctaggcattgcatttggaatctaaacaagtctttaaaaatgatctactcttagtaagacatatctaaatatggcctgtgattaatgaccatctctcaggctcaagtgtaaaatctcaaaataagaaatgtttattgtctcagtgtatttataaaaattttacattatttatttttattattgttatttttttgagatggagtttcgctcttgttgcccaggctggagtgcaatggtgccatctcggctcaccacaacctctgcctcccgggttcaggcgattctcctgcctcagcctcctgagtagctgggattataggcatgcgccaccacacctggctaattttgtatttttagtagagatggggtttctccatgttggtcaggctggtctcgaactcctgacctcaggtgatccacccgccttggactcccaaagtgctgggactataggtgtgacccaccgcacctggccaaaaattttacttaagatagtacctttctgagtaaaaatctagccatgattacccacacatctcatttaaccattttgctaacaatgaccacattataacaattcaccaattaaaaacttctgttcagcctaaatgctgaatttgttatacatataaaaaaaccttgagatattttaagccagaaaatgaggtcagaatcaatcattttcatgaaataaatatatggtcccaagacttagccaaattattaaacctgtaagggaaaaggtctcaaaaaaatgttatactaatctgatgttaggctctttggtaggggtggtggttgaatatggccatatgaaaatatgtgaaaaatttaataattaattaccttgacattttggttactttttgttctataattaatcaaactaatcatattttaaatttgggagaaagaatgaaaggacatgtctgtttcctgatttgtctgattgttcagacaggcctgatattgaaagcttttgatactgagatcctattaatctcagatgatgatgaagttactgtattcttaaagaaacaaagaatttaaatagaaattaaatgttatttgtaattacaaatattagtcttttgtaatttatgaaacttcaaacatgaaaaaattagatcatgaattagtttctgtaagttatagaaaaaaatacaatgaagttaattaaaatcatcaaattgtatcattgtgtatatatctttctattcctgtaacgtttatttttattcctttttataataaagccaatttttttcttgtgaaaaatattttgactccaggctttttatattagtgttaaaaattctttaagtaaccaggtaaatgttataacagcctaggttgtaaaggagactggtgtgggtttttgtgtgtgtggtttttttgtttttttattttttttttcttttcatgcttagaaaaatgattcacagactggggaagtagagggtgagaaaaagacaaattttttttttaaagaaaaaggtaaaaaggtgtatatttattctaccctctttctccgaaaccctgatttatccattcccccatctgttgttctttgccgcctcattttgttgtaaaacaccaattcagaaaatacgtttagaaaagtacatacacttcattttccatttaaatcactggaaaaagtattgtttttctgcaatctcacttaaaagtgtttatagttgtactaatatatatgatgctttatgtttaacacatatatgaagcatttattcgtataaataagcacagtaatataaatctttgaagttttatttgtggaactgtgtttcaattctgtagtgcaggtgctcatctctgtattactagaaactattaatcacattttgctctttgcacctttatttattttcttttttgagacggggtttcactttgtcacccaggttggagtgcagtgctgccatctcaggtcactgcagcctccacctcccaggttcatgcagtgctcctgcttcaaccccccaagtagctgggactaccggcatgtgccaccacacccggctgatttttgcatttttttgtagagacaaggtcttgatatgttgcccaggctggtcatggactcctggcctcaagcaatcctcctgccttggcctcccttgggattacaggcgtgagccaccacacctggccagcagttcattttaaattgacatctgctttaaaaattcagattataaaacaaaacaactatatatgtatattgtgtgtgtgtgtgtgtgtgtgtatgtgtaaaatgtataattataatactttcatgggtttctatttggctaaagggataatcccttacagttattctgaaatagtaagatcatgtattttaggtatgtttttactcaaaaataaaatttaataatacctatatatcaaatttatgggataataaaagagatttgtgctctttgaaatatgtaaatatgatgtctcactgtgcattacagttgcccttgtgatgtacagagctcaaaataaatgagtttcttttgtttctgtgccatttagctaaaggcaacaaaaataattaaaaatgtttttactctttgggaattttatggttctgatttattaaaaatagaggtggaggaatctttgaaaagctgctttgtaaacccaaatacaaataacgtggaattgatagaagaaaagaagataaactctggaaatgtatttatgaaatatttattattgtgaaaaaaacttgtgaaattattctttttgttttgttttgtttttgagacagagttttgctctgtcacccaggctggagtacagtggccagatcttggctcactgcaacctccacctcccaggttcaagcaattcctctgcttcagcctcccaagtagctagaactacaggtgcacgccaccacgcctggctaattttttgtatttttagtagagatggggtttcaccatgttggccaggctggtctcaaactcctgacctcaggtgatctgcttgccttagcttcccaaaatgctgggattacaggtgtgagccaccactcccagcctttttaaaattttattttttgagacagagtcttgttctgttgcccaggctggagtgcagtggtgtgatctcagctcactgcaacctccacttcctgggttcaagcaattctcctgcctcaacctcctgagtagctggtattacaggcgcctgtcaccacgcccggctaatttttgtattttcagtggagatgaggtttcaccatgttggctaggctagtctggaactcctgacctcaagtgatccgcttgcctcagcctcccaaagtgatgggattacaggtgtgagccactgtgcccagctgaaattatttttaatgtcacactttttcctttccttttgcaaggaaaaagcacgttttattgacatttttagggctttttaaaaatataagttggttaaaacttttatctagaatgttttctcttgcagcgtcatcagttactaatatagatagcactattattgtaaagttagtggcgttagaaaacacatttgggagttaaagtgcttatttgcaaataatgcaaacataatttgtgtcctataaagggaaaggaagaatttgtaatcacaagatgaagacgttcaaagctcagcttctctcttgttaccaagttagagaaaatcgatatctgtttttcagataattatttagaatttagtgatttttttaaaaaaaatcaggaatatgagaattatcacataatagttattttatgattctaaggcatttgtgtggcagctaataatgcatttgaaagcgagcttttgctttcacatacccatttatgtctgtcttgtaccatttctgtgtcagcgttccttaaaaactctgtaggtcaccttgtcagtatagctgaagataaaggcttgagagttgctctcttgcctaaaagatatgaactgacagctggagatcatggggtaaaggtatgtgagatgaaggcctttggaaaacagctgcttttcagagtataaatttcatggcctgtagcttggattctgaaacaatctttatttcttatcatcttatctgttgttttcataaacgatcagaagtagtctgatagttctacagttcataaaccttgtgtactattactgtatttctctagaatttttagtctgtggtttctctacttagtattaaggcaatagcaaaagtaccttataaaataggaatttgtatttcatagataagctaaggtctgacataagatctaaaaacgtaacttggcaccaccaaccagattgctatttggaaaatgtttctgaactaatgcaacatggtatcttgcctaatggtaatttttctgttataataactactttgttcttttggcctttttatcaggtgcttatgtaaatcaaatcataaaaaattggctgggcatgtcgctcacgcctataatgccagcactttgggaggccaaggtgtgcagatcacttgatgccaggagtttgagaccggtgtggccaacatggcgaaccctgtctctactaaaaatgcaaaaattagccaggcatggtggcacctgcctgtaatcccagctacttgggaggctgagacaggagaattgcttgtgagactgtttctcaaaaaatacaaagattaaaattgagtagaaatgcagtaagggagtctaatgaagctgtttaatactttgtgagcccagagtaaaagaatgactactaagctgaggtttgggtgggtctcctagtgtacaaagtgatttttaaagcaaatatgtttctgtactttaattaatactactgttatttattgaaaagttactatgtgtcaggtactgtgtagtaaacgtaattgaatccccacaatcatattgtgtagatcccatttttatccccattttacaaaactgagcctctgagtgattaagtaaaataacattcagaattcacacagtaggtaggtagtggggccaggattcattctaacaccagaactcatactcaggctgcactataaatgactgagtatgacctgcataccttccatgagtggtgcctcctggaattgcccatcatgcagaactgaagccttatcagtgcacaggactgtcttactgctgtatatttccaagtatgggaacaaggaaattagtccaacctgtttctagtaggaggagacacacataaataaataacaatcagttttgcatgccttaatgatagggataccttttgagaaatgcactattaggggattttgttgttattcaacaaaagcatcataggtgtgcttacacaaacctagatggtatagcttactatgtaccttggcctattgctcctagtttgcaaaactgtacagcatgttacaaaactgaatactgtaggcagttgtaacacaatgctaagtatttgtgtacctaaacatagaaaaggtacagtaaaaagtataaaagatgaaaaatggtacacctgtatggggcacttactatgaatggagcttacgggactggaagttactccaaataagtcagtgagtggtgagcaaatgtgaaggtctaggacatcactttacatcactgtagactttataaacactgtacactttggctacaataaatttaaaatatttttctttcttcagtaataaaccttagcttactgtaactttttttttgagacagagtctccctctgtcacccaggccggagtgcactggtgtgatcttggctcacggtaacctctgcctcccaggctcaagcgattctcctgcctcagcctcccaagtagctgggatcccagacgtgtgccaccatgcctggctaatttttgtatttttagtagagacggagttgcgccatgttggccaggctggtctcaaactcctgatctcaggtgattctccctcctcggcctcccaaagggctgggattactggtgtgagccaccacacctggccactgtaacttttttattttataagctttttattttttttaacttttgactcttgtaataacaacacttagcttaaaacacaagcacattgtacagctgtacaaaaatattttctttctttatatccttattctataagcttttttctatttttaacattttttacttttattttctactttttaaacttttttgttaaaaacaaagacacaaacacacattagcctaggcctgcacagggtccggatcatcagtatcactactttccacctccacatcttttcccactggaacgtcttcagtggcagtaacagacatggagctgttctctcttatggtaacagtgccttcttctggaatacctcctgaaggacctgcctgaggctgttttacagttaacttttaaaatatatataagtaaagggagtacactccaaaataatgataaaaagtatagtaaatacagaaaccagtaacatggctgtcttaatttgaagacctctatcgtatatgcggttcagtgttgaccaaaatgttatgtggtgcttgattgtaatcatatgcaggagtgtagagttgggagtacacagaagggagttaccagtttttactctaggtccctccaggttatacttctgatactgtaaactggcattgctctagtctcagtaagtttatagcatgttcagtgttctatttttattcatcatggctacatctggttgaagtaaggaggaaatagtgttaatttagagaaagtaaaagaggcccagaaaggctaaatgcctttcttagagacacagtaaatcatcggtatcaaagcaattattttgggccccaaatgacagttaatttcctggtagactaggaaatttcacatttccctgaaattgatctaagtaagccaagaatcttttcctcatttaactcatattcttttcaagcctttatatttttctttcatatatatttttttcttttatatgttttatatatatataaaatactttaagttctatggtacatgtgcacaacgtgcaggtatacatgtgccatattggtttgctgcacccgttaactcatcatttacattaggtatttttcctaatgctatccctcccccagccccccaccccaagacaggccctggtgtgtgatgttccccgccctgtgtccaagtgttctcattgttcagttcccacctatgagtgagaacatgtgatgtttggttttctgtccttgtgatactttgctcagaatgatggtttccagcttcatccatgtccctgcaaaggacatgaactcatccttttttatggctgcatagtattccatggtatatatgtgccacattttcttaattcagtctatcattgatggacatttggggtggttccaagtctttgctattgtgaatagtgctgcaataaacatacgtgtccagtgtgtctttataagtagcatgatttataataatcctttgggtatatacccagtaatgggattgctgggtcaaatggtatttctagttccagatccttgaggaattgccacactgtgttccacaatggtgaactagtttacagtcccaccaacagtgtaaaagcattcctatttctccacatcctctccagcacaagcgtttatatttttcaagttcacaaatcttttcctggtacttggcaaataatgtggttattgaaagtagataacttctctgctatatggtggccattgtgggatctggggactctacagtggtacaagctggcttccagggaatgagatagtgatgtggtacctccctgtgcaggtttctgcgtggcttttctgccttgggctaaagctagcagctcagggaccagatgaagcagatttcctcttcctggatagactcaacccgtgttagctgaagcaatatttgcagggcaagaagtctcctgacatgctggagatgctagaggtccagggctgtaggctgaattgctcgtgatggttcccagtgaggaagcaatgcagagtgtgtgcacctgccttcctcctcagagctgccacttggcaattatgccaaacatcatggggaatgatcactattgattcagttttgtcctgtgaactactttcattcatagataagactgatagcaaatatcaatgcatctctgtattgtgcagtatttaatagggcattctttattttccctaatccctagtaaggtggttcttaaattttttttggatcaaggactgctttaagaatttgagaaaagccgggcacagtggtgtgcgcctgtatccccagctactctggaggctgaggcaggaggattgcttgagcccaggagtttgaggctgtagtgtgctacgattgtgcctgtgaataagagttggcacttcagcctgggcaatatagcaagaccccatctgtttaaaaaaaaaaaactggtgaaagcactctctccagaaaaatgcacacacgaaattttgaatgtaattcaaggggtttatgaccctctccaccaaaagctgatctgtgagctgtggattttagtaaataacccttgttgtagactttccatagtcattttgtttgatagccaaagaaatactgtcattttttaacctatggatatttcacaggaaatgtgtttaatgttcttctacattgatgaaaagtcaacactgtatgctttaaatcagcatgcctacctgttgtgttctaggaaatttttgtcaaagcttaaatgttgaatagcaattatctaatatttactttttctccctttttaaagcttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatgggtatgttactttaagtgtttttggtaccttgaaatgaccatatattatctgggtttgttacacatcagatttgggatgaaaattctaagttatatatttgtaggatttttgtgagtctgcaaaccaatattttcaaagtaatttatttcaaattagtgttatgaatattttatctttttaaattgatgttcccttggtttgaaaatgcgtgtgttactgtcagtgcctcctggcatttgtcgttgaaagcactggtgcttttaagcagggtgtgcttataccttttccttttcctgtcattagtccatccatccctagatatgcagaccatattggaacaagaatgtatggggaaatttgggttaactcaggttcatccaaaattgggcttttcaatagaagttagcctatttctggagattagatccaccttcagtcatggtcttctttttcttttttgtcttgcccacctatagcatcacaaaaccaattattgcttttaacacctctttgttttatctatcctaccagacatcttggaatgttcctctaaattttcttctattctgcagcccccttttcctcctgctttttgccactaaacaaaaacaaattgtgaaaaggaggacatctccttgatttttttggggatggggggttagagacagagtcttgccattttgcccaggctgctctcgaattcctgggctcaagtgatcctcctgccttggcctcccaaagtactgagattacaggcatgtgagccaccacacccagcctctacttaatatttcctgtactttctagcaaaacacttaaggcaacttacctgtagtatttaagaaaacataggagcctaaaggtggtaatatcagaaattaagtatatttagcaatacaagtataacctggagcttgaaagatgtcagaccagtcatgggaaacaaacaaacaaacaacatgtaacttaaatgttttatgtttaatttttcagaaatgtcggtgatcacttactagtaaatcagaattaaatagtgatattttccaactttatatgttacatagctttaggttctcccatttcttgttataaaagccatgtacacacatactcttttaaagaaaaattggaaaacacaggaaaataaaaagcttttttcggtatatgattttctgatttttgtctttccataattgtgattgtacactgttaataatttttgtcctttggtttcatttaacattataacctaagaatttggccgtaattaattttatgctttctttatacatgtttttaaatgtctgtcacggtattttatcaaagagatttaacctttgattacatatttgtatatgttttgctttagtttatcaaataagacatgcttattgtgggcaatttagaatatgcaaaaaagtataaagaagaaaaataaatactcatgaaggtatcacccagaggtaactactgtctatatactactcacacagaattttatttttgaaatgaagctttcttttgttgacgttttctcactttttgtgaacattttcccatatgattaaaaatctttgaaaatgtcatttttcatggtcacatgatattttcttacataaatgtgacataaattaggcagctatattcctagttagtactagattttaagaataaatataacttaagttgttcaacctttatgttcatttaaaatatattctaaggatgaattgttttcttatagcttgtttatggaaatcctaaagtactgtacagactgtgatgaaatacaatttaaggaggatggcacttgggcaccgatgagatcaaaaaaggaagtacaggaagtttctgcctcttacaatggagtcgatggtgagtagttcttcacaaggaagaggcagtctccctactgctctaagtctggttttcaatattaaaatccatatatttttaaaaatcactgagcagtttgtggatagcttaataattcctattaacttattgattaaatgttcagaagtaatagaactccttttaaattcacttttttgccagctttaaaaaatttactgatataagatttcaaagtaatgtaatataattagtcatttgtaaactcatacttttgaaactgtaccctttttaaatttttaacagatttgatacagagtagtaaaggttcttttttcatttatttattttttcctggcttttagtatgtttttgctgtaaagacactatgagttttgaaaatgctatcatcgtatttaagtatgtcagatactatacagacaaaaattaatataccgtctgctctcaaattacttttcttctgaagtggacatatgacacattttgattgtttgctctaattcagtaatttattattttgaaaaataatttactattattaaataatagttttaaacttagaagaacagagccactgttggttttctactctctggctccaacaatattgtgaatctaaactgtaactgataaactgtagtgacactgagaaaagagagatgtcatagctcttcccttgccttgtattttaatcattcccatataggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaagggtaagtgctgagacatttaaaaaaaaaagtaatcatgaaaattaacttggcaaatagggattaaagacttgccaaataaaatgattcttgattgtgaaacttaacttagcaatcaaagaatagtttgaatttttcccaggtttgtaatactctggagggattggggtaatgcaccaaaagggtacttggatatagtattcttcatatcaaaagatcattctagtaccgtggttctcaaactgtggtgtacgtacatcagaattacctgagagcttaataaaatgcatacattgcgcccccatgtctgagtcaggagtagagactaagaaaatttgtctttctaggccaggcgtcatgtctcatacctgtaatcctaggactttgggaggctgaggcaggtggattgtccaagctcaggagtttgagaccagcctgggcaacatggtgaaacctcatctctactaaaatacaaaaattagccaagcgtggtggcatgcgcctgtaatctcagctactctggagggtgaggcaggagaatcgcttgaacccaggaggtggaggttgcagtgagccaagatcgtgccattgcactccagcctgggcaacagagcgagactttgtctcaaaaaaaaaaaaaaaaaaagaaagaaaaaatttgtatttctagttaagttcccaggtgatcctgctcctgctcacaggatgtagaacatttgttcaaactggaatgtatgctgtaaaattcaccccaagttgagtgtttcaagtggaaagcagaggaagaccaatgatttaaatctgcttcagaatgtgaatgaggctggtagtgaatgacttctgttgcagcacacaacatttcccactttgcagagttttctcccatattttccattagtcttatatcaataacagtgtacctaggttatacttcagttcatgaaacattgttatctactttgtataaaacaccctcagctaagcatggatgataataaaatgagtaagtacagtcttaaccttaaacagcttagcactttctggggggtggtaaaacaagtagcatactccaactatactctcaaaacaggctgttagtcctgtagacacatcagggattctgagcaagatttctaattgtgctgaagcacaattgtagcacactaattgtaaatctagaaatagatgtgtccctttttaggtataaagcaggagaatcacatggcctgttgcaactgaatagaagctaaccagaaactcttccagcaagcattagggactaaagaaagaatgtaggagagagaaggaagtccatagatggcattgttacaacaccagatcaagagcaggcatttctgtgcctggagtcaaatcattttcaggtttgacattgtatgatgagattaaagatttctatcagtttgagaccagcctgggcaacatggtaaaaccctgtctctaccaaaaaattagctgggtatggcactgtgtgcctgttgtcccaactactcggagggctgatgggggaggatcacttgaacctgggaggtggaggttgcagtgagctaagatcgtgccactgcactccaacctgggtgacagaatgagaccccatctcaaaaaaaaataagatttcagtcaaacatttcacacatcggtattttcattctacagtagtccatcttggcatacagacagaaacaaagacattaaaaacagtatcatcattctaaacaaagtgaataatttaagcacaaatcctactgttatgaacatgacctctgataaaagcctatcttgatggctataacccagcaagcctgaccttgttattacaccaatgtattttatgtctgagtaggagaaaaggaaaagtcacattacctaaagttagaacaagtatctatagaatttcaattccaagatattttgtaaatatcaaaccatagtatgaccaaatacacattgtcatgtgatttttttaagtgccataatcacaattttaaaagatatttcataaacctctggatatataaatacttttgggctaaatgcatcataatatatatatttgttctgttctttagactattaatagtaatatgtatttatgtaaactatgcaatagtattactgactatatattttttctttaaagaaaacatttgagtgtttaggaatctaatatttcttctttggatatttactttgctctttctccaaaaatatttggagaaaataaaataaataatgtttattatgtttggaaaattacattaaatgcattaagtacttcctgaatttcccagtgactaattgaacccagctatagtatttgcaaatgccagacatttctctctctatttgcagataaaaacaagaaacttgaaagtttacatccttagaaggagaataacacaccatagtcaacactagtagccattttataataatgactagttggtaactggaaacctcagtacagcatattgtgtttgttattgtgcagtataaaggttgaaatgcatttcaaaacattatcacaaattgaaagaaaagcatgcagccaggaattagaggcaaacactaaatgtaaaacattttgttgtctttagccactgagtgcttaatgttcatccagaaattgtctatgctgtttgagatgttttcaaagactagcattttaaatcctctcttataatctcttagacattgtgagaagactcagctaatggtaaatggtactttttctagatataagaggtttaacaaagtttccattagatgaaacatttttatgaggcagacgagagtgtgttttatgcttcatatcccattcattaaaatgtggtagatggtcataactggaactctattcctagaaatccaaccttgtcatctcgtgaaatgttcttttttttttttttttttttttttttttgagacagagtttcactcttatctcccaggctggagtgcagtggcaccatcttggctcaccacaccctccgcctcctgggttcaagtgattctcctgcctcagcctcccgagtagctgggattacaggcatgcaccaccatgcctggctaattttttgtattttttagtagagacagggtttctccctgttggtgaggctggtctcaaactcccaacctcaggtgatccatgcgccttggcctcccaaagtgctgggattacaggtgtgagccaccacgcccggccctcttttgaaatattctataccactgaaattgcatccccatgccccaggtactttacatgaagcattaaaagcaaaagacagcctctttattgcttcctttctctttattttctataacacatacaccttcagcctcttgtattgttggggtaacatataacccttatgtttccttctaagagggctactataattgtttttcttttcaaaattagctttgtttttgtttttgttttgttttgagacaggctcttgctctgtcacccaggcttgagtgcagtggtgcaatcacggctcatgcagcctcgaccccccaggctcaagcaatcctctcatctatctcccaagtagctgggactacagatacgtgccaccaggcctggctaagctttttaatttttcgtagagacagggtctccctatgttgcccaggctgggcaacttctgggctgaaactatccttctgcctcagcctcccgaagtatggggattacaggaatgagccaccatgcctggccccaaagttagttaaattattattttttccttcttctccttttttcctttcccttaattgttagtaaattttaaaaaaaaagctacttagctatttaaacttttcactgttttttagagtcctaattcttgttttatgttttctttttccagttatactgttctctctttaaaaactctccactacctattcgttttggagtatttcttcttgtttcactacattagattcagcagggcttttatgcaaacaatgtgctgataactgtactgggcattgggtatactaaacaatacccagtttttgccctcctaaagattacaatctgaggggccagctggtaactccgaaccactcagattgcttcattccctctgtcttattatatgtattttctttgctagggcatacgtatgcttcttaatagccaatactctggtgttgttttaaaagggtttccgactttcatttgatgtaggtatctttcactcatatcccgttaaagtggctcaactgtacctttctcttgcattttgaaagcataggtgatgatattccaaaggcaatgtgaggtttgtgaatgttggataccattgcatctgtccacttcttcctgtggcctctgttaaatgctattatgtatacaaattattttctcataattgtgtataatctaaattatacattgctttgcttggttttgttcttatttccagcactaaaccgagggttcattgtgagatacaacccctttttttgttaaccttgagagtttaactggctaatgaaaactatgccaatctttccttcttccagcattttaagtcttccacatcaagcatctccagtatcccgcaccccaagccttcctgctgtagacacaagctacattaatacctccctcatccaagactataggcatcctttccacatgacacccatgccttacgacttacaaggtgagtcactggttcttctacattgtcacatagcattatgaatgcctttgatctatataattctcttctaggtgaatctaaggaagaactggaagactgagccaacagggccttggacccagggaactgagagaaataatatgccgttgttataaatactgacccagttcgttgattgtactgtcatcagtagccagtgttttactcccagtggtaaaactagtgcaataatctttagtttttgtgagctcctgagtactctgcaaattgtttttgaatgactgctagtatgtgggtttgaattttggtatttatgaacattatttttttttgccgtggggaacggagtcttgctctgttgcctgggctggagtgcggtggcacgatctcagctcactacaacctccgcctcccaggttcaaacaattctcctgcctcagcttcccgaccgagtagctgggattataggcgcccactaccacaccaggctaatgttttatatttttagtagagacagggtttcactattttggtcaggctggtcctgacctcgtggtcctcctgcctcggcctcccaaagtgctaggattacaggcgtgagccaccacgcccagccctgtgaacattatttattgtaccctgactttagttgtaatgcaacaggcattgtgggtaactatgttgtattatgttttagataatggtgagttgagacatttgaaagttttagtttttattctaatgaatttgatccttcttaaaaattttttttttaattttgtgggtacatactaggtgtatacatttatctgatccttctttttaaaagctgtttgaaatgtcagtatactcatttatatattttgagttcataataatcatttatattatcaaaaagaattgtttttatatctttgtagcataataatttgaatattagtcatataatctaagaacttttttttattaaaaaagccatatatgctcattgtagaaaattcaacacagaaacataaagtgaaagtttccctctacctatcccccaaccccattcccgggaagttacagctagtgtgtgtgtgtgtgtgtgtgtgtgtgtgtgtgtgtcggagttttgctcttattgctcaggctgcgtgtgtgtgtgtgtgtgtgtgtgtgtcggagttttgctcttattgctcaggctggagtgcaatggcgcgacaggcatgtgccaccacgcctggctaattttgtatttttagtagagacggggtttcaccatgttggtcaggctggtctcaaactcccgacctcaggtgattcgcctgccttcgcttcccaaagtgctgggattacaggcgtgagccactacggccagccagttacagctgctcttaacggttagatatctttctatacctttttttctacatgtatgaaacgcactgtcactatcaagaacaacagtgctatgcattttgtaagccttcgtgttgtaatcggttataatgtagacagtgagtagatgcccagagtatctgtggtgttgtaatatatttatctatagctgcgtgttttacctttccccaagtttagatatcataatgaagcatttaattcatgcttgttcacttgctcttcatcgcattacacactgggtgatctagaaaagaatgttaattggaaggggcctccttgcagtgaatcctcagcagccaggtagcagaactactccttcttatgtaatagtagccagtttgcaggcactcaaacctcttctcccctcatgccactgcagtctgtcagttgaatctgatagcaaatgagcaaatttaagaaagaaaaatcagtactacaacttacttaacctaactctttcaacttcaaactttctcacctgcaaaatgagggcaaaactaattacatacctcatgaagtgcttgtgaggagtaacttagagcagattgaaagtttccttaagaggagtccagagcatttgttaaaagtactatgcccgtttaaggatcagtgttagatctgacagagtagtaatggccccagtcccccaaatggggtcacggagaagacaaatcattgccaaagcttagttttcagccttagtaatctaaagaaaggagagacgtaaaacgtttagctcaactcttcatgtttaaataaaattctgagtgacatagcatataagacttgtatttgtttttgaagtattggggcatttggaagagtttttccttcttttttttttaaactgaaataattttttcttccacaggattagatttctttcctttcttatcaggagacaatcaggtatgttatgaaaaatttactattattttaattgtacattaaaaatacagtcatgcgccacataatgacattttggtcaatgacaggccatatatgcattccataagattataatggagctgaaaaatccctacatcaattatagccatggtaacattgtagcacaaggcattactcacatgtttgtggtgttgctggtgtgaacaaacctatgctgtcagtcatgtaaaagtatcacacgtataattatgtacaatataacgataataaacaactctgttactggtttatgcatttactatattttttattgttattttagagtgtacctctactttttttttttttaagtttgctgtaaaacagtgtgccatgttattccaggacagcctcatacatcccagtttgccacatctcttgattgcatcatttcctcttgtgcttgatgaaaatcttgtcttgttttgttcatcatggcccctaagcatacaaaatccacagctaatgttgccagtaagaggccacatcgagtgactgacatggaaaaaaattaagtgattaaggacgatgaaagtggaagatcagtgatagttattgctcaccagtcaggcagtcccattctaccatagctacagtcttaaagaacaagaacaaagtgatagaagctgttaaaggatctgctttgttcaaggcaacaagactaacaaaaatttgagaagggcctgtatcagatatggagaaacttgttagtgacctggattgaagaccagacacagaaacatatccctctcagcaccataatgatcatggccaaagcaaaaagtttgtttgcaatgcttaaagaaaagactggacccaactacagtgttaaatgtactgctagctccgggtggtttaaacgattgaagaatcattattcattatgtaatatcaaagtgagtggagagtctgcaaatgcagatgtgaaggcaactgaagaatttttggaaactctagataagctgattatgaaggaagattacttgccagacaaattttcaatacgcatgaaacctccctattctggaaataaatggctgaaaggactttcatccataaagaagccaagtcaatgctagatttcaaggcttttaaggacaagataacagtcttgcttggggccatattgcaggctacaaattgaaaccctttgtgatctggcacagtgagaactccagagccttcaagcatgtcagcaagcacacactgcccgtgtactacaggagcaataagaagtcatcgatgacccagcttttcttccaggatgtcctcccgaattgctgtgccagcaaaatggagaagtactgttgagagagtaacatacttttcaagatgatgatttttgttgataatgctcccacacatcctcatttcattggtgatcttcatcccaatatcaaagtgttgtgtctccttccatataccacctctttgatccaaccaatgaatcaaggagttgtagcagtttttaaggcctattaaaagatcctaaggaggatctttgcccaggctattgctgcaactgaaaaacaccgagaggacactgatgcaattctggaaggtttacaacagctatgactgcatcaagaaccttgcttgggcatggactgatgtcaccaaggagtatgtgaatgacatctagaagacactgaagaagtttgttcatgacttcaaagaatctgctaaggatgaagaggttgcagaaatggacaaggctgtggttgacatggcaaacaactttaacctagatgtagatgaggatgacattgagaagctcctagatgtggttcctgaggaattgactaatgagctgttggaactggaacaggaacacgcagctgaagaaggtgcaagagaaaaggaaactgcaggagacaaaaaggaagaacctccaagaaaattcacagtgaaaggtttagcagaagcttttgcagacctcaacaagctccttaaaaaatttaaaaacatgggccctggctgggcgctgtggcttacacctataatcccagcactttgggaggccaaagcgggtagatcatgaggtcaggagttcgagaccagcctgaccaacatggtgaaaccccgtctctactaaaaatacaaaaattagctgggcgtggtgctacacgcctgtaatcccagctactcgggaggctgaggcagaagaatcacttgaacctgggaggcggaggttgcagtgagccgagattgcgtgcaccactctactccaacctgggtggcagagcgagactccatctcaaaaacaaaacaaacaaaaaaaacatgggccctaacaatgaaaggttttcattaatagagaggaatgtttatggtacattatctacttacaagcaaacctatgataaaaaagaaaccaagccaaacaccatggacatatttctgaaaagagtgacacctccttaagaagagcctcaggcaggtccttcagtgggtgttccagaagattgttgtcatagcaaatgacagctccatgcatgctattttccctgaagaccatgcagtgggacaagctgtgcagatggaagacagtgacatcgatgaccctgacctccctgtgtaggcctaggctaatgtgttgtgtgtgtcatttttaacaaaaaagttaaaaagtaaaaaatattttaaaatgttaaaaatagagacttacagaataaggatataaagaaggaaatatttttgttcagctgtacaatgtacttgtgttttaaattaagtgttacaagagtcaaagttttaaaaaatcagtttataaagtaaaattagttagctaatgttaatttattattgaagaaagaaaaatatttttaacacatttagtgtggccatagtgtacagtgtttataaagtctacagtagtgtacaataatgtcctaagcctcacattcactcaccattcactcactggctcacccagagcaacttccagtactgcaggctccattcatggtaagtgccctatacaggtgtatcatttttttatcttttataccatatttttactgtaccttttctatgttgagatatacacatacttagcattgtgttacagttgcctacggcattcagcacagtaacatgctgtacaggtttgtagcctgggagcagtaggccagaccacacagcctaggtgtgtagcaggctctactgtctaggtttgtgcaagcacactgtgatgtttgcacagccacaaaaccgcctaatgatgcatttctcaaaacacatccgtgtcattaagcgacgcatgactgtatttaaaagtataatgtgtagccaagagaaagataaatttccttggaaaacttagagtaatcatacccattatcattatggctttaaaatttaaataaaaattctaactttcagtggtgcctgagtgtataataagaacagtgtctgttggtttccagtactgttttataaagaaacagggcagtgagtcatattgactgatagatttcttggctaagtatctccttactagcaagagcatggactgtctgcccctcctgctgcttctgagcatatgcttcttgggaaatagaattggtaattgcttgcaatacaaactaaaacaaaaaacaataaaatttatattttgtttttcctccagtttcagatacaaaaatgtcttctcaagatcaatgctccagtccttacataaggccatttgattttgcaaaatgtcttagtaaatatttcagaaaccctagatactcaggctatcttaaatttagggctgtgtcccgctgaggagaaaatatattaatttggaagtataattaacatttttgtgtcttttgtttcccctccctagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaa

SEQ ID NO: 1906 - DNA, 86066 bp, Homo sapiens
gtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtaggcagcagcagccccgggtgtgtgtgctcgggcgggggaggcggtgcatgtgtgcacggctgccgcgactctcttcctgtcactggcagcggcttctccttctgcagagccccgccggggggaagcgggctggccaccggccctccccgcctccggcatctcctggccgccgggcagcactacccccgcgcgcggccggcgtcctgtgagatccccgccatcctgactcccgtttcccccgtcctcctgcgagctggtcctgcacgccgccggtcgcatttgcccccggagttgccgacgagctcgggcttcctcccaccctccgtcaccgcacacttcggagggtccccgctgtcgccttgctgcagttttccggggcccctcaccggaggagagcgccctggccgctgccttcgtgttgcgggaaggagcgctcccttcccccgtggccctccagctgcagccagggtcgctgcccgggcccttcccggggcgggcgaggcggcggtggtccccggagctcgtcccctaacccccgccttccgaagtttgccgccctcctcttccggggtgggggaagtgcgcctcggggcggttggtcgctggggccctaactcagcgtttattgccagccaagcttgggcaggttgttggaggcatatttagtggggtcttggaaccgcccggaaatccagcttttggaacgtggggcgaggcgggagggacctgcccagcaatatggagccggctggggagagccagggagcctgcaacccggagctaaaatatcgtgggcaattctctggaaaccacagctctaacctaagctcagaaactgcccctcagatcacaagacaaagagaacagaaaacctctggccaggcactcctgtacagaaatacactttgataaccagaattggagcctgaaatgcaaggatatatgcagaatggctgttacgtgttgaatgcagaatgtgtgtcaactgggtttgggggaattcttctgtttcccggggcgctattaatatcggaaaggtctcacttccaccgttaatcccttgagctgcagcgctgttggtgtccgagtgtgagtctgctctttatttgggggcttcatgattttaggttttttttcttttttctcttcttttcctctttgtcagccagtgcgaagtaccaatggataaagcagttccgggttttgaatgcaacataagattgtcattttggtgtgatgaggctcaagttttagtaatcaggagggatattcacagagcttattggtcaaggcttgatgtggagttatattttaatgcttcattagttctgttacgttttggcaaccttaaagatggttagatattagctaggaagggttggagtgggcagacaggttcatttcttaagcaggttattagaatattagattgtcacagtttgaattactaggaatttggtgacttctgcacagaaggccacaagtatcttttaacattgaaaaaggaagaaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtaggtactagataatcatattactttttccagagaagtggatagatttttatgattgggagaaagtttaatgtatctgatactggcttgcaaagtgtaatgtgcatttacttttaactttcatcttgacttgggacctgttcttagttgcataacagaactctgcagtgtacacactgctatttgatgttttatctgctttttaaaaataatgatatcagtgagtctcttcctatccatgatgctgtatagtcagtgtaaaaagcattttgtttcccatttattgaatgttttttctttagcgatttcttgagtttaaatatactaagcgcaggaaatcctcacagaataaagttggttctgggaaacagaagtggaacaataagttataggaatacatattttgattatagacagtgatgatggtggtatgcgtttatcttttggtaatgtcagtttcacctaacgtgatttttgaaggactttgaattgtaaatgcaaacctactcaaactaacccaaattttgtactgttaaaagttttggccatttctttacatttttccatgactgtcatataatttttaggttgatatgttgattgaacatatcaacctaaattgatatgttcaatcaacatattggtcgttcaggggagtattgtaaaaaggcatctactctgaaagattgttcacatgatcattaaaataggaacaattctagttcagcttttattgtgtttgcattttgtgatttgcaaaatacatgttttattgaataaagagatggtgaatgagcaggctgaaaaaaaattgatttttatgctcaagtagaatatagccagttgagataatgtttgtgttgggttttggaattctctcacgtcaaggcatacacaatgcaaaagatattgtatgtttcatatgagctcctccagctctccctcttgcagggcacagggtttgcaagtgaaggcaagagaatgaagcattttaatgaagccctggaagactagaaagttagttatcaatggaaggaattatcaagttagtttttactttagaaagcagaatataaattatatcacagctttttatcaaaacctaggttttaattaattttcaaagtattcatatcatttactgcattttcccatgcctcctttacgtacaccctaatgccctaatgtgattacttgccatgattctgccaatacttgtatggagttacttgcttaaaagagtggcaattaacgaccatttcatgtacattaagccacatgagctgaaaaaatagactatatagttacttataaacttgtctgtatggcctttatttatcccctaggtgttaggtgtttatttatttgaaaggctagagtgattgtagtatagtgttattggaaaaaatgtctactgtagaaacatctttggagattttattctgctagcattgttttccttaaagtaaatcaaatacatatccacaggcacctgtagtcaaaatagttgtcaggttaatgatcatccaagagagtattgaagtcacaggagtctggccacagtgtgaggaggctccaccagtgagtgtagtgagttaataaagccaaggcatctggaccagccattccttgcctgttgtcttcctccccggatgtcccagtgtcccagcctggggttctgccccaggatcaagggctgtaccatgaggacacagctactcatctctaaatcctggggatgcacacacacatgtacacatcccttggcctctcccaggcctcctttgtcctgacctctgtagagccgtcctctacctcaggtaaggagagaactacatgggcaaagtccacactcagcctttatctatttactccaaaaggggtttaagacagcgggagttttattttagctagattcaggattcacttagaactgtttgcagagttaagaggcaatgcagaagaaaatccctcataaatgtttgttcctctgttaaatctgaattgtataaatggcagtaggtgacattcaatactaatagaaataatagtaatataatagttgcaatttactagctatgtaactttaggcaaaatatttaacttttatctgcttgttttctcatctgtaaaatagagataattgttgtacttagagtgattgtaatggttaaatgagttgatatatgtacaactctgagaactatgtgcctggcacatagtaagtactatgttggcattaattatcctaagctcctattatcaagtatggagcgaagtgctttatgtatgtcattttgttaatcctcataatgactctgtgggctgtaggtttgcttatagctgtctcacagatgataaaactgtgccacagagaggtttaagtaactttcctgaggttacatatttaggcacaatctgactggggcagctgcctgaatctgaagctcagtgttcatactaaccttgccaagaagtttacagaatagcatctttttttcaaaagaagagagacttgaagtcatccccttcagtcctctcattcctgccccctcaggtcctcttcattgtgatgatgcagagaaccggaatggtcagcctcatggccttttctgggtgataggatctgtctgtccctcaggtcccagaagctacgtcaccctttctcccagcctccgcgtaatggctactgcgtgcctaagcgttgctgtcacctgggccagggtcattcctctgtgtttcctgcagtaccttcccctcatgttggctgctttctgaagagccctagctccttgttgtgttacctgggcttgtgctacctgttctcctctccctcgccccacaaacacaacaccaaaagggcttgtaggcgagaattacagcctatacagcctgtttacccacaccacacacccagccctgagcatggcagcatgcaacacattctatttagttggttggtttggaaatgaatttgatgtctattatttggggttaatctcagcccattattttcattttattttaattgatataaagtccacataccataaaattcaccctaaattcatcatttcaaattgaaggcaatttattatgtttactaggtgctctgggttgaatgtgtcccccagagtttacatgtcagaaatgtaatccctaatgcaactgtgttgggaggtagggcctaataggaggctgtgctctcttgaatggattaatgtcattatggcaagagtagattagttatcttgggaatgggcttgttataaactcgagtttggccctgtcttgctgtcttgcccttgcaagaggacataagatgaaggccttcaccagatgctagtgccatgctcttggactttccagcctccagaaccaaatatacttctgttgtttataaattacccagtctcaggaattccattataacaacacaaaatggactaagacactaggatattttaattttgttcgtcttgattttcatgatttctgggacaccatgatttggaaggtaaaccatttttaaataatgatttttttaaagactgtatgaatttaggtgaggagcttgacctagactctgaactagcacactgaagttaaaaagatggactgtagagagatatgggctgtgggcccaggaacccttccataccctcctgccttggttgaagacccatttcgtgctgccatccaatgcctaactgctaatttcattgggagatagaatcacatgacttggatatattcttgattaatttaatgtgatttaaaaatatcctgtattcctgcctgtccatcaagttctccaaattcttgtcatttctaaatggagaatggagtaactcaacaaagtcagagagggcttttttgtttggctctttgccaaaatgcctataggttagagggttacacagaaaatctactttacagcagttgtacgttaagtagctgtggattgctatttgtcaaacatcagaaacaattttattttggggaatagaaagagaatttctctgtatgttagcagggacagaaaatatgcttctgattaatgggattgcaggcagtcattagaaggattgaaagactggagaaaaattccttaaaattttgaactgttgcatatgatattatataagagtaagttagtttacttgttcgtaggattcctttataccctttgttacaataacttatgcatgcactagcttggagcctatatcacaaaactgccttggttatttgaaaatattacattgtagataatgttatctacatataaaaagcctttgctatgtgaataatcatgtcagaactgggtaaaaatagtttagtgggcaggtatatgtagcaaaagagaatagaggcatgatagagtgaatctgaggaaaaatcctgttgatttggatagtttaggctccaggtcgatctcggtaggggtggtggttacacaggtattaccaaatacctcaggctgctgggtcttctgcagtactgtgaagaatttgaggatgagagaaaagagaacttcccagtcctctagatgtgacagtccttgtggcagtgccatatccccctaaggaggagctgggttattggaaattgttcagtggaggggcctgggatagtggcaggaggcagaggtgctaaggatacaggtggcagaagcgaagctcatagagcagaaataggcaggattccagaagtgggcagccttccagaagtggtgtgcccagtattcttttattcactagtttatggacttctttcgcagggacacattttaatgaagtctctttggaagaaaatttgcatggctgagatgctgggttttggagttgatggaactgccgagttaaaatagcttttttgtgtgtgcaggtagtgtgaaagagccacatacactatcagtaaagccgctgtctgagagagttaaagaggcagacagacagttaaggttaattggagtgatcagcttgtgcaggccacgaacctgcatcatccacaccaaagcaagttgagttcaggcagtagatgctggaggtgttaaaaatgggacttacagagctagactgcctggatctgaattctagttcctcttcgcaattgctaagtattatcgtgacagagatattttctgtcctatgttaagtgagactactgatagtacctgtttttatatagttatctacacacacacacacatacatatatgactatatatatgactatatatatatgactgtatataactatatatagtcagcatcatcatatcatctaatactaattgggagctatatgtgtacaaactcaatcatcatcatcatcatcatcatcatcatcatcatcatcatcatcacccaatacttaaccggagttttatgtggattaacccattcagtcctcaagaatgacagacgtcaaaatggacatggcagtcaggagaaagtgtacaatgtgcaaaagagtaggggtggctgccttctctgtctagctaagggctctctacatcttatcaccatgctgtccagtccccaccccaatgacttgactgctctccttttttttttttttccacaacattgccctcagaccacttaattgacactgactaatggctggccttgaattaacgtctgcatcaatggatggatgccctgtttgtatccatcttcctggccttactttggggtctcagaagacagaaatggtgtgttctatttaccatcctagagtcatagaagatttgtggttctttttatcagatgaggacccagagttctgcacagggttcttcttacccacaaagtaaggttcttcttacaggtggcaagggagagagaatttgtagagacctttagttctctgtcacttcagacagggattgcctctctggtgtctagcctctaaaagtcatcatgttccttaggtttctatttccctttgcacaaatttagcctcaggcagactcaagcacagcttttaggtttgtaaaaccttgacaagtcctggagccttttcttaatacagagccccctggcaaggaacagcttcagaggtaagctgtgagcaggggcttgcttgatggttcctggaggattgaagatggggaagagtttgttcattatacttcccattctattaagaatcccaccaaactggcccactgggtggctggaataaaggaagtgttaggaagcagctggcataaagatctacccagcctactggttgaggatttttttttcccccctaaaagacatacattgccaggaaaagctaacaaaaatttcaaggcagatttggaggaattaaattattcttaggcacattgcctggtttctaagcatttagggatatgtaaatgttcatgttctttagaggtctctgtctcttttgtacagagtacattagtactaaaaatgagatttgctagttctacattttcatgtgaatttatgcagtgaatattcaatttgattctggatctttcaaaaggaaaggctttctttaaacaaataatatagcttatttttctgatatgctctattggttgctttgatttttttctccgacaactgaaatgcgaagtagagtactatccccaattaatattcttgctccacaaagacttccagtgtttgtttttgcttcttttaatatgtaactctcctaagtgtgttattgtattacagctaagaggctttacccatgtaaagttgaatactttacacttctgaatgccaacataacaattaatctatgattagattttgcttcttaagatgcctccactgacgagtgcctgtaatattaaacttctaaagtgttccactctttaaaacttataaaagctctctttgatatagcccactgaaattgtgtggctattgtttttattgctttattgtgcagccagcttaactgaaacctttgggtggcttttactctttataataaagataacattgagaaatgcctggagtacaaagtgtatatgtgtacatgccgttctcagccatctactctgacttagtaactctctaattcccttgcctccactatgtttaagaacaaaaaagaaaaacacttacatttcacatttcctccatcaagctgtctttatagagtggtctgtagcaaccattgctacttcctctctaatattttttaactccttaagatgttgttgctgtcctcactgctggactggaatctgcgtgatgattccatcatgggcgaagccccaaattatttagccttgactcagtctctcctgtctggatgcctttgcaggatttagtcttagggatcacattttcctacttgaactcttcttccttgtttttgggatgttgtctctaaaccttgactttccttcctcagttacatacattgaacttcactatttggcccttggatcatttttttttttttttaacttttgatttgtccttgtgagctcttccattccattgaattcagccttgcctaattgtggccgattgccaaatccctagcatgtttcctcttctgaatcacagaccagggtttcatcagccactagcacacttgcacaggggtgcccagaatcaccgtcagcccatcaggtcacctggcttctctttgcctgatagtgctccaaactctcattaatgcaggatcaggcaccctttgctcctctcgttctcgccgcacatttaagcatttgccacatcccacatgttctttctctgcagtgtttatttcactcctcccctttccacacctgctgctgccaccctggtttgtgtcctcactacctcttggccagacctctgcaacacacctttctcgcacactgtggttagattgatattcctggagtgcagctctgatcccgttgctcacttttcaccaagccctttccgtgttccacactgtgggctgaattactcacaaactcagcatgggcatgcgtgatgtcctacagcccctacctaaatctctaaccccaatcccactgctccctctttggctccagacggattggactgcctgttctagctcttctcagaatatgacattttcttggtcacttctgtaactagcgtccgaccacacatgccattctgtcttcagattcctgcagttagtgtgctttctccctcgtttgaaccctgcagtgtttagtttctgcctctcttatgacatgtactagtgttgtggctctgtgtactctgagccacattatcagcgataatgtcacattatcgctaagacattgcctcatgccgacactcctcccctctgcccccgcccggtgttcttagaaggcagggactgccttactaatctctgttgtgtcaagcaatagcacactggcctgtgtctgtctgccaaatcgattaagtacttgttgaatggaagtagaaattccaattaacacagatggcaaagtgtgctgttcattcttaagtctcgtttttttcattcctaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaaggtcagtattgataagtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgcagtagttatatattgaggagacctgactggcatcacaggatatttctggaagagattctgataccactagtaagctattataccttctttaatgttgccttattctaacacaagtgaataagacaatgagaacagagaaacagaatgcaagggtaagagctgcctttcagtattgagtagtaatagattgggaatattgtgttaaaatcaaggaatttattaatgatacctgaagggaagcccttttctttcccatacccagcccaaagggatacttatttcataaatgttatactttataatgttcaaataatatcttttattatattgttcaaaagccaaagttaatttttctttgcagatcaatcaaaaaaccatgactctccgcacatacataagtgattttatcaaccattgcagcacttagcagattgaagatacatacgtaatcgtttttctccaccaagttatatattttcaccttttattttttttaagttaaaaacgctttcttcagtagcctaattccaaaggaaaagtgatttaatttttccgagaatacagagctttacagaatcataaaaatagttgaattagagaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctctgcttttgcaaatcattgattacttaacccacgatatcgtttacttattacgtttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcatacaaagcttaatggcccatcttgttttagaaaataacagcttatttgttatccacatccttcatctgaggcatcctgccttggccttaaccattgcctggtatgtctccagaactctttattttcttcccagggcctgggacaggtagttctgctggtgggaaagtgcattaagctgatagtaccttcagtcacttaagccaagtgagtagaggggctgtcatggtcagcgaatatcctcagggcaaattctgtgccctttctcccatccttttatctccttccctttgcatgggggctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaataaaaatatattcctctgtcatatgtaagccatccagtggggctatttctcaagacagtggttttaactcatactttgagatcctttaattaaagtcatgctaatgcagaatatttagacgggtgagagtctgtgcccatgttagtttgtgcagtgcagtgaaacctgctaacacaagagattacttactgcatacccacctccatcctgacctgcacaaccctccctggctcctcctgcagcctctgacagtggatttcagctggtttcaaacctaagacataaagcatgcatttgacatggcttacgctaaattttgatcaaaatcccttttaaacagaaagaaaaaggccaccattggtgttggttttcatggtttcccaaggcatgttattgttaaatttttcacattcagcatttgagtgtcccttcatggttgttgttccctgtccagaaagcagggctgcaataaatcacaaacattgactacactgtacagaggtcacagaaaatagtgacctgatcccaaattacacacctctgctgagcccgttggtcataacctacgctgtctccttgaggcaaatagtgcttgtgcaagtaatttgctttgcttcacaaattcctgcctttacgaattctgttttctttcagaatatactttctcataacattcttcactcttccttcctacttaagtctttgctgtgaacttggaggtttgtcttgttaagcccaagtgatggggaaaaccacccaatttatggtgctgactgctcattctgcatctatcgaccactctgtttttgcgagaaagttgggtcagttacaggatcttagaagataagggcctttgagctctgtctctaacttctgaccacaagaaaagttcatcaggacattatggagatttttacccaggcatgaaaatttaagtgtttgccctctgtgtttcagtaggaaatgaaatatatttctactgaaatataattgattaaagagtgtgtctggaaaaaacaaatgtgctaattattttgaataaaatcagattagcctaaccacttagggtcacagaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcatttctccctccttccctcagtctgttatttgaagggaatcacttgaactgctctcctagagctgcggtgacagttaagtccagggttgcagaataagacagtatttgaggagaagaagctttctgccaggtgtctgtttctgcctctgtcctttagaatcacagggttatggtaggcaagttatattttcttatttaagtgaaatgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaatttgatgatcaaatctgatatccaagatcgtaaagaatataggcataaatgaaatataaatctgtgatatattatttgaatcagaaattccacattgctttgctttctataaattccttaacgttctagttccagtgttctctaattgtaagatgagaagctaaatgctgtctcttttgagtttcagcagtttttgttttaatccttctcttcccaatcagaagaactgtcggagaaataagacccagaaaaattggttctcactagtagtgtttccccaataatgcaacccagaagccctgtatatgagaataagggaatgtagtgagaggatttatgcagagaaacaacctaggatggttggaaagatgtacttacatgacctcattgcacgatctgattggagactggtccatggattgtatgggattattgcttatgaaagtgcccacctggtatcaagtttttgcagatgcatgcggtgtatggttttaagacatgtttcaccagtgtgaatatttaggctctacttctgttggtgggcagttagcaattgctggtatctaaactggtttgagacttactgcctcatttgaacagtatctgtgcagtagcgctaaactcgttgacatgatctgtactgagagttcctacagatttgtttcatatatatttgttaaattttccaaggtaagtagagagtgatggttataacatttgtttattcagacccctctaaatctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatttttttttgcattcttgtttcccaactatagaaacatagctgaatatttgtggcatcattaatgcataatttcaaagcattttacacattgttaattaaatctcaccatgttctttcaggtagcaaaaagtaagtttatttttgattcagaagtatttgaagaagttagaacaagatgattttattgctaaataataaggaatatctgtggagtaccaaggaatgagatataatgaatttggttagagtatatcaaagtacatattatagtttttgtcttacacttccctgtgggtctgtttaactattgaaaatgtcttcttcaaaatgaaccttaaacatttgcaaacttactctttgctaattattctgccaggcatttttttttttcttttttttttgaatcttgctctgttgcccaggctggagtgcagtggctcaatctcagctgactgcaacctctgcctcctgggttcaagcagttctccagccacagcctcccaagtagctgggactacaggcacatgctgccacgcctggctaatttttgtatttttagtagagacagggtttcaccatattggtcaggctggtctcgaactcctaacctcaggtgatccacccacctcggcctcctaaactggtgggattaccagcgcgagccaccacgctggccctgccaggcattttatagacatttttcatttgacgctcacaaccaccctgcaaagatggcatattataacctttttttgtttgtttgtttgtttttttgagatggagtctcgctctgtcgcccgggctggagagcagtggcacgatctcggctcactgcaagctccgcctcctgggttcacgccattctcctgtctcagcctcccgagtagctgggactacaggcacctgccaccacgcccgtctaattttttgtattttttgtagagacggggtttcactgtgttagccaggatggtctcgatctcttgaccttgtgatccgcccacctcggcctcccaaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccaccttggaactggccttttcatctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatatatgactactttaaagaaatacagacattaacatatgtatgtacgtatatacacatacatatatacatataaaattgaccatatacatatatttgtgtgttcaacacacgcattatttttcaggtactgcactaaccttttattccattgacttgttacttttcctaagaactctgtgacactggccttattatacctgttttaaagataaacaagtttagttagagatggcccaaggtcacacagctagtggaggagctgggatttgaccccaaacagtctgactgttgacccaatgctcttaagcaactgtgcaatacagcgaaaggggcgccgggggttaatgttcacactgcttgatgctgctgacttccgaccagccacaaggcaccccggagccaaaggcagatgactccctggcttgccagtgacgtgtgatgcggtctgatatgacaaagtgagttaaacaagcagatttttcctctcaggaaacagacacaagaacaactgaaaagaataaagcagatgtgtgagttactattccttacagcaaaagaacctcatcagaaccgcaggctggaaagaggtgattacttttaaagggcagttcattcctcctgcatgttggaaactgtggctcttaactggctaaaattttaactttcagtgtagccctcacttggcttgtgcttcttaatgttgtagataacattatagatttatataatattcaacttttatatatatattacttatatataaatgtttatgtataaatatatatttgtatataatatgtattcgtatatgatatgtagtaaatgttatatttaaaccatcatatagaaaagccattattgggtacactgtacaaatctgcctttataattgagtgtactgttctactaaaagcagctttagagaaaggattgaaagccagctctttctacttcactagccttcattgtttggattggcattatgtgtacagttatattgtaactgtcacttgtggtctaatcttccccttaggggaaacttgagaaacctggtcagctttaacatttagaggaagtttaaacatattggagcataaaattcacagttgtttaactgaaactccagttcttgtcagaccacatctctccagcccttctgtgattggaatcatctaactttggccctcaataaggaaaactttgacaagatgcaaaaaatgtttactcttgttttctttgccaggaacctgagtctgcagcagactctgagacctctttgcctaccccaaataagtgaattgtcactgtaactgttttttatccccataactgctttcggtgaatgccaatctagttgttacatgcctttaatattttgggtaattatgttctttaagaatgaaaatattttttccttccttcctttcttctttccttcctggttttgttatagtctagctgtgagaccagttgcctttcatatattctagaagagaaggatgaggtgagtttcacagtgatctttttccaaaatacaaaaccactgtcactctccacttcccaggcaaccccactcattctattttctagtgagggttttgcttagatgatgacgagtctcttgattcagtggactcctaagggaccatctttcaccagcaccaaatgctgtttagttcacatattgaaatgttttaaattataacttagcaattgtagttagtaatcttcacattatattgtctcacatttaatgtataatttcctaagagaaggaaatggtcctggtgggggtcaatagttatagtaactattaataatactgatgactactagttaatagtaattaaggcctcctaaaatgagaggaaaaaaaatcttttgtttataaggtttaaaaagaagagttgatacttaatagttttagtaaaaccccagtgcatgttcgattaattttgttactttattctgggcatgtagttgaataattacctgcatttttgatttgctgaaaaggtggtggttacaattttttttgttttttttttttttacagtactgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggttttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgattttattggaagcacgacttccagtgaggcaaggcagtaagccccagaagagaggccttccatgggtagataggaactcaaatgctttcccaggctggacccaggagactgtgtcagctactgtgatatggcttgccaccaggacagatcattctacccgtctaaggagttagggtatccccaagagctgtgatgggaggtggaaattcacacctgtgaaatgggaggtatgctgagttgaacgggatagcccaaggcctgtccatgaactgagccatggccaaggatttcttaattctagaggcctccttcttgagcttgccttcttttgaacttggccctcagtgtctgggtaagttggagcgtgactatccagggaaagcccctggtttgtatttagtcaagttggccagagaagactggatctaagcgggaataaaatttgctgacccccatctcagaggttaacattttcatttgtgttttgcatgactcattttaaattacagtgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaagagtaaggcccattttgagccctttgcttctgtattatgtgaaacataacttgtatgtttcacatatgttcttggtatcagaagaattgttagtttttgaacatgtaaaatctactagggtctctgactgttaaagtataattttgattaagaaaagatttgttccactgctttgattagacacataaaactttgaaaagttttgatgttctgtttcctgttttaaaaaaatatgtcctctcctatgaactctaactagatgagaggattttcctcagagaaaattcagccctgggaagaaccatctatggaggtcataacctagaaaattcttcaagggaagttgcagtgaattaaaagagggcggagttagaaagtcctgttctaccaaatttgtgctaatagttgcacctttctttctttcccagaatggtcactggagaaaatgtgtaaaccaactgcaaacaagtttatccgttgccacctttcttttcctttagtgacagttcaattcgttaacctgaaggagctactgtaccatcaagactagctcccagcccagggcttcagcataaagcagctgctcagttaattttggtggatcacgggcagaaacaagttacctttgggatgcagattctgaatagtctgccatgaaatgattaaatgaatgagagtgatgaggggctacttaattggactatgtaaaatggctccttaagcttcgtggacaattgagtaatttcagtttcctctcttcactcttgtttacttcctgctcttctagcatcaagtgttaggtattctgttctcttacaatgagaagattaaacagctgtagtttaaattaaagcattaatttggagtgttctgtggctacattaattatattttctactaagattaaattgcagatggatataagcagcaatatatgtttatccagggcaaaccagaattctgttaaccagccatccttggtgactttttatttatatataaaaacctttttaaactgaaataatgtaacttgatttttccccccagttaggtagaagaaaaaataattggatgcagaaaacagttgtatggagcgtatttgcataggtacaggacttgagtgacagaaaattccttttatttttttccccagtgggatttagcaaaaagcatgtgttgaaagtctcttgactaaatggatcataattaaagactttgggatttatttatgggtattttaattagaaacattaagttcactcagtggtccttgtgaaaacttttttctaactgcttattttatatcaagtaataaataaaatttctgtgggtatgaagatgagttttagggccgcctatttctctaggaccgcccccccgccccccgccgccgcttcagagagcttttctctttctttcacctattaaacttctgctctggacctcaaaaaaaaaaaaagagttttagctgtaaccacattgtaattcgtgctgaatatatgaatgctgctgttcactgaatagttaactggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcaccttttttgaggctgtccaaagaagaaatgaagttagattattgcagaattacataagttagtaagcatggactgaccagttctttctaagacacatacttgagtatttattctcttcagttgcaatgaaggtgacagtgaatttgctgaatagctgtgtacatgtttccccaaagagaccactggaataaagttttgtttcttgagacagtttccattgcatttataagtcttgtcccttgaaggatgttttctggtaaacacctgtattctttttacattatatatcttcattaccgtacaagtttggttgtgagccattccaaagtctttagtatgctgtatgggtgtattctatactttataccttatttggaagtcataataatgtcaaaactatgcctagccatccccttccctgcagagtctcttttgctttgtccacttggtgtgtatattttttttttttttttttgagacagagttttactcgtcgcccaagccgcagtgcagtggcgcgatctcggctcgctgcaacttctgcctcccgggcccaagcgattctcctgccttagccccccaggtagctgagattaccggtgcccgccaccacgcccagctaatttttgtatttttagtagagacagggtttcaccatgttagccaggctggtctggaacgcctgacctcaaacggtccatccgcttcagcctcccaaagtgctgggattacaggcgtgagccaccgcgcccgtccatgtgtgtcttttttattttttgttttttgagacggagtctcgctctgtcgcccaggctggagtgcagtggtgcgatcttggctcactgcaagctccgcctcctgggttcacgccattctcctgcctcagcctcccgagtagctgggactgcaggcgcctgccaccacgttgtgtgtctttttaaaagatttccaggacttctttttcctttacaaatccaaaattgcagtagcttaataaataacaaatattttggttttatgattactgtcaaatagctcattagtaagagaaaaaaaaaaatgctgagccttaagaggggagaggaaaggcagtctttctgaagctgaatcctttgcctaaattgtcttagcaataaatcttgccacctattggtaaaaaggaagaactaaaactaaaaggtgtttgccgttctcacaggtagttagtagtgtgatcgaaatagaattctttcagcggtgcttttggataaggggcttggaaatatgtgatttgatatggaacttttccctgtgctttgaatttatcatggctcatctctaagtcataatagttttttgagtagaggaggtatgctgctctcatggtctctcttaaaattatattttttgagatagaattccattttaatagatcagtggattttaattggacacattttagaggcttgattgattttgaaaacatttttcttttttctttctttctgtctttctgcctttctttccaccacggctaactgcagtctgaacctcctgtgctcagttgatcctcccgcctcagcctcctgagtagctgggactacaggcgtgcgccaccatgcctggctaatttttctgtagagatggggtttcaccatgttgcctaggctggtctcaagtgatctgtctgcctcagcctcctaaagggctaaaattataggtgtgagccactgcacgtggccttttttttttttttttcttgagacagggtcttcctctgtcactcaggctggagtatagtggcatcaacatggctcactgtagccttgacatcttggggtcacctgatcctcctacctcagcctctggtgtagctgggactacaggctgaaaacatttttctaactctgttgttagtttgggctttccttcattccagcctctgaaatccattatttcctgcccaacgggacaggccagtggtgacgttggcctttggtgccagggcctgtttttccagatcatgggcaccatacaaagataactgccctaaacggcatcattgccccagagtcattgaatgtccttaaggtgcatttgataaaacaaaaacagttttttgttttgaaaattctcaagtatttccatactgggaaaatgttctttttttttttttgacagggtcttgctctgctgcccaggctggagtgcagtggcgggatctcaattcactgcaacctctgcatcctgggttcaagcaattctcctgcctcagctgggaccaccggcacatgccactaagcccggctaatttttgtatttttagtagagatggggttttgccatgttggccagactggtcttgaactcttgacctcaagagtgacccatctgcctcggcctccgagagtgctgggattacaggcatgagccaccatgcctggccaacaatgttctttttaatggtgttttccccactatctggatagatatatgaattcagttactaagatgacttagatttaaatataaaacactagcatagcagtttttgattcttaatattatcttaaatccacctcccctcattgtcctctgtatctaaacacccttcaattcttgagaaaattaagattaccaaagattagtaatctatttgtgattgtgtgtgttggtggacatcctaacaaatttatgaataaagccaatactgttttgttagtgtccttattttttctttacgtctgttcatatttggaattctaaggcactacccagataatcatttgataccctttgttggcatgacatgtttggtcaattgttttggcaaaattatttatccaccactgggaactaagcactgtaacaactaaagaaagaggtcatacaagggaaattggaagaactatatgttatttgtttcaatttttatgtagtacacctatatatgtgtgcaaaaaaaatgtaaactgttacaaagcaacatattgatgaatttaaatgagtagagcataataaaagcaaaaaccaaacagaagagtggttggagtgaggccataataaaccaagagatattttctgaaggaagtgaacatgtttgcattttccagcatactgctatggatgtcagcgttaggctaatacatagtattgcagcgtgattcaaaaaggtgagatagaggggaaataagatagcttcataaatattaccaaggaatttaagacatgagcattttatgtagggaggttgaaatgcattgttataatcaggctgtgtaatttccttctgtcaagacctacccatttaccagtaatgataccttctttctcttctatttttgtctcttcctttaggaaaaggaatatatgcttactcattatttaaaattcagagtcattttcctgttccagttggttttgttcctggaaccaccaaagaagagtagaattaggtgcatgtgaaacttttgtttctgctttttctactcaatcaacttttatccctttttaatttttactctctcaaccatcagttctatatcatggtatctcttcttggtctttttgtattatatttccataaaaccagatgtacggggttgttaaaatactgcctggacatattatctaccctgcactaagtggtcctatcacaaaatccagttaaacacacattgaagtatttaaattgtttcttttttaaataacatcatattgggcattggacttcttaactaaactatttctttcactaaatgacattggttaattcaacaagccattgtaggaattctgttaacccagtagcttctactactatgttactatggtaatgacttagcttcccataaagctgcatttaaataggtgtttatagtcaccaattaccaggtatttcaagtactctttgaaaggggcctgcttgtggtggggtggggggcgttaacatagatactttctcagtcacgtagccatttgaagtttttcaggtagaagacagttgatagactatttggtgagcaaatgaataactggatgaatacccatctgggaacccctaaagaactgaagatagttccctggccatcactgttcacagtcatctattatgtgcttactctatgccaagtgttgggctggattctggggtcaccaaagggaagagaaaattttcactgccttgagggtagctaaaaacttaatggagggaagctgagagcatgagcgagcgtgccaccccagctgggtgagcggcacaccttgggaacagctgggagacccccagtggtgtgtgtcttccttcgcccttagcacttgctcctctccagctcactgtgtttcttttctctctggggtctaaggagcttaggcttcactgcctgctcctcagattgtgggagcaggagcagagagtgggtgcctgccacgggacagggggtcctagagacaggccccagcatgggaaggcagtggaaacccatgcattgctctctggcattgccacacgtcttctgctgcctgccttccagccctttgcttttccccagctccgtcagctccttgcctctgacatcagtgatgaaagtcaggcgtggggggattagattatttccattggccttgatagacttagacatataatagaagctatgataagtgagttagttttccatgtttgtttactgaagtttatattaccctttatgtcaccaaaacatgcccgtttgcagtcattgccaatgtagtcatgcaaaatcacttgagtgaaatagactttggggatctaatctcaggacctaaccaccatttataaagcttttttggggaaaatgtgttctggatttcgcacagccagcttacaaatgagctttggaaacacaatccacatgtaagttggagacttcctattattagcattcagccctgcgaggagagcccttgctttgttagcaggcctatgtgtcctcagccctaagttcctaaaaccagcactacttgaggagcttgaattggtgctcttggagttctttagattagttatgagacttcagaacctgcttaccagcagtactgagctcaagaggaagcctaattcatatccttcagaagataattttaagagagtgtgtatgttttcgttttgtgaacaaaggaaagttaatctggtgctccgtgtctgttttgtaattccccaagggagaaggaaagggagggaaatgattgatttccagataggataaaaaccagtcagcacacaatgggttactgccaccgctttctgataaggatcctacttcaactatctgaagagattcttcaaggtggaggatacagtggttatattagttactctcacccttgttattatggaaggtaaaattcctggatcctagatttaattttaaaatagtaatttaataatgtctggtggaaacctcttaaaaaaaacactttgcagcacatctctggtagccctgtgcttgagatgacttttaggctgccagttcagaagatggaagatataaactgtgttgatgagttggtttttcagtggaccctgttaggttccttttttaaaaaaataataatttttataatgagtatgtcttcgtgagccctcacaacccttgaagtttttacttgtttggcagaactaagggcactgaacgtttgtaagccgttcactaacacttacaggaagggcataaaagggtgctcaagtcagtctgtaggtggtgggggcggggtggaaagaggggattcctgtaggcctggatgaatcagccactgatttctgatggtagccccagctgcaaaaaagtaggaagctttttttatggacagaactacaactcctttctttcaagtttttcagccttttcacacttttccattcttcagactttgcaagtttttaaacaaaatgtttgtatttccccaaaggaaatcacacagttgactgcattatgagagggaaaggagcaaactctgtctcatctgaggaggggctcagatcaggagttgtgtagggccctcacccggttgggggtggtggagccttggctgtgtgcaggagtgactgttcttggagatgttctggttggatcatgagtttgggcttggaaagcactgcctcaagttcatcagcaggaatgaggtagaattcactacttgctgtcttaagacctttctgtctgccaagtgtttgagcaatccctcacatctcccccttgaactaaagagcaacaactggtcaagagcccagcagggatgaaaaaggttggccccttgcatccttcatctgctgtttagactaagggccgcattgtagaccactctcggccatgctgtcctgaacccgaggatcagcagaattacaggcccaatttcaggcagacgtgagcttgcatctgatgacaggcaagtacctacatgtgtctttcattactccgctgccttaggagatgctgtttaagttggcagatatgcttatttgaaagcaaagcttgttgctggtgagattactgaatttacaaaaaaaaaaaagtggggggatcagatgccaagggagagggaagggagtgtgtagcatttaaaagtgtggtgaagccatcaagttaacaagaaaaagtagaataaaatgtggttccaatttgttgtactgggctcaagatgataatattgcaatagtaaactgtagggatgtgtgcgtgcaaatgtgattacatgtgtgcttgctttctgaatttcaaaattgtagaagttattagaagttctaattttagttcccaatttaatttactctgatagtaaattagtaattttcaagggatttactgataatcagaacaaagatttgcaatttctaggacagatccccaattttgggggtgggaaggagctactttgtatttccctgaaaccttgagttactggggccgaacatgtagggcagatattgaatgaccaatcctaatgctcttagcaactttgctaagtaaaaccccgctgccatccagtggcaattggctatacggcatggtagctgtaaaatatgcccttttctgccttttctccctcagattccacctttctcagatgctcccagttttttttcccagatggcacctgacacagtacttgacaggaaaaattgactttatgtctggcttaggtaattcagggcaagtgtgcatttatttaccttgtctcttctcctagcaatactaatttttatctacgttgcatttttattttctccccagatttgtcataacacacatactttttccttgaatatttttgttaccttagctaaagaattaatgcattgtggtatttctgcttgtcatagttttactttagagtagatttcgcttatatctttgtatttatgctttgagctgtggtttaccaatttcctagcatgtttcatgacacttatcctacatttcagacaaggatttatgtgtcccataggattcaagctggacttggagaaagagccagctagcaaatggaattattctgacttgtgaaaggttccagccttttaaaactaggctctgagaaataaaaaaacaaatattcttgggaagaaactgggtttgtgagtacttggctagaaattttaggaaaggaaagaacatttcctctggcctcgggagcacattcaatgtgaaatattgctgcctttaaaagagccaaacttaaatttctatttggatcatttacttgacttaaaaataaagggatctatttttttttaaggttcagaaccctattttaaataaaatgacattctagtaagtcaggcaagatgcccccaacatgagctattaattaaaaacagccggaacttctggaggtgttagcaagtatctactatgagcttggggattggcgaaatctggtacaagttagttccagctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttgtataaatcagttgaccagtcagtgttggagcaaacttctcaggattgctctgtgaactccctgttctctggcagttgccaaatacaaagataaaccaggagagacttattcccaagaaaagaatgattctgcatccttaacttacatataaactgttgagatgtttcattgttttgtatggtcaagccccttctcttgttctctctcttcatcaattagtatggaaaattggaagtttactgaaaagagtttcgaatcatgggattttagatttgaaaaggaccagagggatcatctactcttccaacaaataaaaaataaaacccccaaaggaatgaatgatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtcttaaaattttatataatacaggggagtagattgcatcagtacagtctttttctttttttcttttttttttttatgatgcaaacaaagcagtatcttaaattaaatcaaggtttcttaaggttccagattcttattcctaaattttccactgagtaacctccaaattcttctcctgcctttgtccctagttgacacaagtcaggccacaattttttttctgcaaatggacgagctgctgctcagaggctgcacttactggtgagagatccttcaagggaaatgaatctggaatggcctggaacatttgtctttgggttgctccagggctttattagagcttctgagatttctaagtaggtgatgaaatttagcagcatctgattttctaaaatgaccaaaggagaattgtttcagtccctgatttgcaaagtactcactttttggtcctctcaaaatttttgtcagataaagatttttccgtgccatggatataagaaataacccactcttaccgataaagggaagttagtgttgtaaaggaacaaatggtgattcaggtttgggagactttggaggtattcattctccactaagctatatcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatcaaaaaaaaagtataaaaacattttgtaattttttatttatttatttttgttgagacggagtctcgctctgtcgcacagggtggagtgcaatggcgcagtctcggctcactgcaagctccacctctcaggttcacaccattctcctgcctcagccttccgagtagctgggactacaggtgcccgccaccacgcccagctaatctttttgtatttttagtagagacagggtttcaccgtgttcaccaggagggtctcgatctcctgaccttgtgatccgcccgcctcggcctcccaaagtgctgggattacaggtgtgagccaccgcacccagcaacattttgtaattttttaaagggctacataaattcaaggtattattgctgtacttcttttctgttaccttatgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggttaaaaaaaaaaaagtttgggaaagaaaaaacaagtgctcaagacaagcctcctatttttcagtttggcctagccctagccctattgaagaaggttagtacattcacctggccagttttagctaacttggttacctggcaagtggcggggatgcagtacattagtacttgtcctgtggtacagagcatgtgtctcagggtgtggccactccagggagagggaagacgtgctttatggggcctcctcagccatcactgtgatatgtgccaccaggaacccaggacctttcatggtccagtctgaggtgggagcaccacagaagcaagagctgcctggcccagccaagcccagattaccctaaaatcttactgcttttttcccttcagcattttaaattataggagcaagtaaaagtgtacataacgcaaggcaatctgaacaggtggctgatagctgctccatccagaggaagagccatgaagttcccccgacccacacatttcaccctgtcttgtctaccaaaaatcacatgaaaatgcagacataaccatggaggagtaacccatgaacaaagggctggtaattacagtttaatgctgttctttttacccctttggctggctggctgtgcaaaggcaggccccggtaattacggtttaatgttgttctttttacccctttggctggctggctgtgcaaaggcaggccccacaggggagtaatgtatttgtgacagccagttggggtggggagagatgggctgtactacactttgaatttattatgttctgctaatacttttactcctatgctggaaagttatgttttccttcctttgttagacaatttttgcagagtagtttaacattttcaaacatttactatatatagcacttttaaaatccaggaactgtcatttccaaagaagattccatgtctataatattaattccctgtcctctcctcattgcctttttcagacatccactgtagatagcctctgttccccaggaactaacatttccaaaggaaactcccttgcctataattccctgttatcttcttgttgcctctcctgaataataatttttgattcagtaccttttagctatttataatgttatcgtataatctgagtttgggaactgcttgccacttccagtttctgacacccaaaacacattttatgcttagagaaaacaatagcaccctgactttttagaagacatagttttcccttggggatccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccatagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttcgacctctgccctctttaagttattttcatttgtcttgtagccagtatcagacatgttaatgaccactaactttgtaaatgaaattattgcagctcataatgtcaagatgtgaacctaagcaggccttaggttttctgacttaatagccgaaccataccagtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattgaaggccatcctctaaagccatgctgctcagtgcaggagccaccagccacatggtcaaagccacacagagccactgaaaggtggctgctataaattgagatgtgttatgagcataaaacaagagagaaatgaagactatctgcttaataatttttatattgattatatgttgattatattttggatatgtggggttaaataaaagattaaatttcaccttttgtttttgcttgtgatgtggctactagaaaatgtaaaattacatgtgtggcttacagcgagaccccactatttacagggcactgaaagtcattcttcctcttaattcctcatctaaactctactcattgactattttgtgtatctgcatcttttcttccaaaatgaatgatcagctgctagaaggcatgactatggaaacagtgtatcttctactgtgatttttcaagagtgaggaagtttggctatcaccatgggcgtgaggagaggggttctgttctcatttggtaaacatacaccagatatgctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttcctctctgtacaatgacaatgatgatagaacctttcttataatgttatgaaagattatattttctgagataattttagtaaagcaacgtagcatagagcctgatacatgttaagtacgttgtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctgtgcatgcatgggttaaaaatttcaaactgtccaaatgaattgcatttattggcaatttaatgctgaaactcaaagagggaaaagaggagaaaaaaaatcaaagatgaagtggaaagacaagggcccttggatgcagccggacagaggttgtaatatctgctctgccaaacactagttaagtgatcttggtgtagtcaccaaacctcttgagtctctttcccacatacaaaatgaggttgatgtgtttcacaaggctgttatcatgactcaaggaaataacctaaatgactagggcagtgacagttcacctctctctcttcatattgctctcaatttcatgatcttcttctccccgcaaccccatgatttatagaagccaaattacgttctctgatttatagctgttgtaactttggaatacatttaagaacatggaattagttgtcttttgttagatccacatacagaagtcacagaaatgttttcatcattttgaattttactgttcattctggcaaagtgaaaatgtataccaaaacactattttaaaccacctatcccctgggttagaaattataagttagtgtagcccagtgaagtataattaaatgttgccattctcccatttatttaacttccttccctccatatttgaagtaattttcgcttggtgccaactccagtcattctccagatgcctgtgatttcttccagattttcaacacacagtggctaaagataatatagaattattttttaagtaatttgtgattaaatgtaaatttagtaattttatgttgggacatgtgatctccttgacattttctccaaaacacagaatttaagcactagaaatgattttaggacatctagttaaaccattaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggttacattaaatggccccaaaaagtaatttatgggctaaaatgaatgtcttcagaaggctaacataaaagatgaccaacagggggaaacctgaaacagccttttaggtaatttgcttaacttctagcccttttaaaaaaattactcaagctcatgttagagccaacaaaaaacatctgttgttttatttatagccacaatttctaagaagcatattctatagcagatgaaaaagtagttgacagcttataattcataaagttactgaggcctaatctgatagaacaaaatgtacaaactccctcccgtggttcagaccctatcccttccctttctgctgaagacagaaatggtgcaacagaggagtggagcataggttattacggttgttaaggaagaggcgactctgagatgataatgcagaaaggagtaccccgcagtgataaatgattgctttcacctctgggccatccaccagcctgagtcactgctactttttcattaacattgtatggactttcattataggaagccaacattttgctgtgttcaatctacagattgttaacagcgtatttccatcaggaatctaaagtgttaattaaaacgactgattgaatagttccctctctgagggaagcttttagtttgccccttcctttcaccagttagctgtagtctatattgacataactttctccctgctgactcttaagcaattattagaattcactcattactcaaatatcacctctctgtatctgttggcttatttctgagaatctttttgagaacatgaccaggcttctttctataatttttatatatatatatatatacacacacgcacacacacacatacactacatatatatgtatgtagaatacatatatatatctatatatgtacatatatatctatatgtatacatatatctatatatgtatacatatagatacatagctatatagatacatatctaatgtatacatgtatacacatgtacctacatgtatacacatgtatctgcatgtatacacatgtatacacatgtagatgcatgtatacacatgtatacacatgtatctgcatgtatacacatgtagatacatgtatctgcatgtatacacatgtagatgcatgtagatgcatgtatacatatatacatgtagatgcatgtagatacatgtatacatatatacatgtagatgcatgtagatacatgtatacgtagatacatgtatacatgtagatacatgtagatacatgtatacatgtagatacatgtagatacatgtatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtatatagatacatacatagatatatagatacatagatacatatatatttatatatgtacatatatctacatatatatctatatatacatatatctacatatatatctatatatatatttctacatatatatctatatatgtagaaatatatatatattctacattttagttctgctatatctatagggccttctgtatatcacagttttgtgtgttgttgtttttttttaagtgcattggtttggcacaaataactatagtactatttattatcctgagcttttttgagaatgtagtgatagggttcaacatctgcccaaattgacccatctaaaattataattctaaaaccataaccagaagaagcccattaatttctttagtagagaggtgagtagcctcttgtttatttcactactgatcatagtctattgtgagatatgaagatgtattagcccaccagaattaatcacctttgtctgaagtagtgaaagtatattgcttcattttgttaaactctgattccttacacaattgttaaggattgtgtttacttttatctcaaaattgttaccttttaatatatatagtcttatatcagtgatcttttcaaacttttaaaatgaagtctgaataaatattattttcttatgcatttcttctgcaccagctgatagggaattttctgtacaatgttttcaggcctcttgcctttcttgcctttatttttctctgcaattccacacacaggtcattgctttcccttcctctccctttttgatcatggatgcttcaactcccttcatatatttgttaagcatattttactaagatttcattttgtgatgcttgcaaatatacattacaaaatatatatttttaaaaagtgatttgaagggccctctgtccatctgatgattaactagaagagtcttttgtaccttgctaaaagtgataagttagccagctatatttagctggataaaacccattacatccttggggaagaatgtgctttgtttagctttatgagaaaatatttaataaatgctgtcttgaaaatatttagcctggctgagtgagctggcaaggcttcaatactgataaagcagaggtgatggtgaaaagctggcctgccagtccaagctcaagttaaaaaaatgcacctcttgtcactaagggttgcaactgtcgccaagtgcttgtccatcagtgtcacgtaaagattttttaacctcacatatggcatcatgcagtttgtctgcctaaaaaggcaacctagattcacagagtggttacaattggctttgaagtcccatctgttctgtaaaatcctagctttatttcttactgctggtatgactttaggtaacttgtttaatttttcttaatctcagttttctcatctgtaaaatggggacagtgataatttcttagagcgttgtacagattaaatgagattaaacgctgagcagagtttcttacactaagtgttcactacatgggaattaatcagcagtagtagtgatttgtaatcagcctaacattttctgtccctccctaactcctcccaccccacaggagatacaaagagcaaagtcctcttgaatgtggcgaggtaggaaaggctctggcatgggcatcaggaggcctgggtcctcggcttgaacttcctgtgggaccttgggcaagttgtggctcacataatccctccccactcatcagtacacagtgcacagggcagcagagctcctggctgctagtctctcttttgatacctaattcgttgtggtatcagaccaaatttgatatgatagctagacccgccggtccgtcagtatcatttggggtctggtgtaagatcagcctgtgaaactcaggcatgtaggcaacaagttatcagtaagaaggtcaatcattgggattctgtctcccacaatggtctggattttctctctgtggctggtgggctcagccccaatccttgctactcaaagtgtgattgtggtccgaggaccggcagcatgggcatcacctgggagcctgttggaaatgcagaatcccagactgcaccccgacctcctgaatcaggctgttaatatgtacattaaagttggggaaccactgcctcaaactactgcccttgggaatattctgacacgcagagggtatttatttactaaatacttacagaatttgtgtttgacattgacattttctagacaaggttccattcctctctttgggtgtagtgtactgatgtgttaggtcagggttaccataacaaaacaccacagactggtgtttatgtctgtaccaccatagacatttagaaatctatttctcacagggtgccagtgtggttgggttctggtgagggccttctccctagcctccaggctgccaccttgtcactgtgatctcacatgggaagggtggggagaaaggtctctggtgctgcttcttataaaggcactaatcccatcgtgagagcacttgccctcatgacttcctgtaaactcagctgcctcccaaaggcccatctccaaatattatcacattgagggtcagggcgtcaacatgaatctggggggaagggacacaattcagtctgtagcaactgacttccacatctgactttaaaatgcatctttaaaaaaaatgtgctggcagataaatatgtaaataaagcaaatatgaaaatgttaatcgtagaatctaggtgaaagataatgtgggcgttcactaaacaattctttcaacttttcaggatatttaaaaatgtcagagaaaaaaccccctactctctatagttatttaaaaggaatctggtgctgcttttttctccttatttccatccaggctttcttaagagtgcttgttcggtctggctggacaaacttgcctttttggcagtttctctctctctacccactcactttctccttggtcagccagtggcctgcttctgcactgtcagtgaggtcccagcctggatccaaagcttctttctggtctctagtctgccagtagcatctttctgtccagttcctctccatccccctgccctctcctaatactaatcaggggatccttcaattgcttgtgacatcgcagcttctcaagttacattttacaactctgctttattatttttaagcatttctaacatgacattttataagtttgactctgaaatttatcatcacatgtaagtaggaaagaagtgtctccacaagtttgccctcagccagagatagtgtggttcatctggaatgcccctgcctttctctggttattaataggggctcctattgcttttccatttacagtgttaattatctgcatttcaaagtagttcataatgagagggaatatattaacttgttatttggggaggaagtacaaaaactgctattatcaagatcatttaacttgagcataatcagaaagtattaaggttattcccttgtgggattgaccatcagatatctgtgtgtttcataacacccttattgcagataccttttaaagaagggaggcttgcaggaagtgttgggaaacttactataagcttctttccttgactggcacttgtatactctggcgcagggaagacaagcccaaactaaatacataggcattacttaagagctttgtgacattggacaaatagtttccttgcctttaaactggggataatagagactatacacctttgaactgctatgaaaaataaatgaaaatatttctgtaaaatacttactgtgggaatgtggctcctagttgatgttcagtactaatcattcattcagcaaacagcctaccgcccactgtgtgtcatggcctgtgatttgtcttttttctttttgggggcttctgggtcatacttcgtatgaaatctttcttagcacaccgaaagaccaactttccttataaatcattggcttcaaaaatcctgtggactcaggtataaattatttttctggtgaggagaggaggaaatccctttcttccccatttacatcctgcctagctattttaatttgctgtacaccgtaaattgtaatcttagaatcaaactccaatttaggtgataaggatcacaattaattaggctagcctgtcaaagattaaatgtaatcttgcatttcagttacctcctaactctgaggctttagctaagcccgtcagaaacaaagctgttaggtctgcttaggtttaataagatctttgcctgctgtttgttttctataccagtctgttgtctagaaataaaacgaatggacagaggatctcaattccctttcatttgtttttagctgtgcagcaggagagataaatgagagaagataaacttaacgatattaaagactaattaggatatctgaggagatttgcaaacttctagtttaaatctgtcggcaactcttttaattccctcctgctagttatctctgaaaataatgtagttatggctgaagatttatttccacatctactctttgtactctcattttcagttgcgcatactttttttctccttcttcctccaaaaaaaaaagctcttgtttcggccacactcaatataatttagcacacagtcattccaacttcattttgtcttcacattcagaaaactgaagtctaatatctcaaatatattagtattgtggtccttttggggaaagtatgataaattgaaaatattttggttttgacttctgaagattttgagtattgtttatatatacaaaggcaaaatgcaaatatatacaaggcaaaatgcaaatgtgcttccagcttgcttccttagaaaagtattgagaacagtctaagtatgataatttctggtcttaaaacctgcaattgcaatcgggtatttccataatctaaacaataataaagattacatgactaattctaacaataataactacctattagtttgtgctttctacatactgggcacgatgcctgtcatgtttatatatatatattatttaatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagagagattcagacagaaacagctttgactcagcagcagttagcagacaaacatcttgatataatactgatccacactttgcatatacactttcttttctttgtattacatttttagaggtaagtggcagtttttcacacacttccaaactgcttccatcagtaatgaaatatttggcttgggcagcctctggagtcccagtgtttcagcttaaactttccagtgggccctgccaggcactaacttcaaaatatctttttttatggtgaatgcctccagaaggtgcaactgtgtggtggtttcattttgcacttcataacggtgttggcatcacttaatgcaaagaatgccactgtctcccacacaccgctggtgcccaaggactgtcgaggcctgtccatgttagtggtttgggaagggctgaagtttggagagaaggctctttttctattccatgtgattggctgtcaccagggcaaagggggaaaactagaacgagtggaaaatgcagcatcggatgtgtcatcaaatattcttcctacaacctgggacacctagttcattggtgttctggtcaacattgaaggctgaatcctcctttcttttgaaataatgcgtgtcttggattcactacttttaaacctttctgctgatctttatccttttcttcctaagcaatactgatttctttcaatgaaaaatgatttagctagtgaaaaactgggattgggttgtagtaaaggaatcaacaaatttgcccagattcttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttttgtatggagcatttgccagcccagcaatataacaacttttgggtgcatatttcaatcacaattagatgaaatctttaattatcatttaatttgactttcatatttgcctgcagaaatgattgtgttgataagactctggaatgagacaaacctttattaagtaattccattttcagagccaacattaaagttttttttaattaaaaaaatgcctgtgtaatttatgagaaaaggggaagaggaattggcatgttggttgcatgagagttgcatggatatgtatttactatttaatctttagctttttgagatttggggtgtgctaagtcttgttagtttgaggggcctaaggagtgacacaataatggatcttaataaataacacttttctacatcatttctctacctttatatttcccttctattatatatgctgacaggatgatatttcattgtattcagtgtagaaggtgtttgtgagagaggatacttttgtgagttgatattaaggcaaagggaagtggtttataatttatcagaggaaatgaaatggtgtgctctttcattttataatatttcttttaaaattttataatgcttttaattggactgtgaaacctttaagacatttgtatttgaagtgcttttcagatatatttacattttaacatacagggatttgagagatgtcattgctggattttttcataggatcacccacatgaattttcttatcaaaagagtatgtcctaaagcttatttctaaccccaaacaggttactagcccattcctggatgttccgattctgaagatttagggtggtacctgggaatcagtatttctagcacgtcctccaggtggtgcttagctctggcaagtgtgggagagaccagagagaggtgaagttcccacccagccctctgcacagtgactggaaagttaatggccagtcgtttgtgcttctatgaaacctaagatgtgttacagtgatgttgcagtaggacaaagtcactcaggaaatcgagtggtaaacattgcagggctttgagttcaaatattgattagctctatgttaagatgccttgtcttcagggatagctttagagtgggatctctaacacaaagctgactcgggaatctttcatctgccattgacaaaatttgcccttgtgcaggcaagtaagactatactctctaattttatgggcactagccacctatggttgtttccatttaaatcagttaaaataaaaaattcagttcttcactgggaatggctgcattttactcaataaccgctgtggctagtcattgctttatcagagagcacagctgtagaacatttccatcatcacagaaagctctaatagtgctactgtaggattttccctcataatatagctcttctctttttatcctgggtagttgcaatggctaatagaattaggtggaaagatcatgcatccatctatgtactgcacattgcatactgaaatctgaaagaatgtttttgcaaaatgacttaatcatacttctctgagatcaaaatttaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggggggggaggatcacatgaactcaggaagttgaggctgcagcgagccatgatcacgccactacactccagcctgggtgacagagcgagaccctgtctcaaaaaaaaaaaaaaaaaagaaaaaggaaatttgtttaccatagtatatggcttctaataaagagctatactggtaaaatctcacagaaacaaaattgcaaatatttagtctttctcagattatataaattattcctagaaaagactgcaagcaatgaggctaataaacaggttgtacttatattttcataatgactttaatttacctttattttgcagtttcacaaatttaagatgaatatatttagctccctcttctggcataatttgagaatttttttgcttacaatggtcttatttattttttttggactgagaataaggttatcaatgtaatgttgaagaatgttatttatgagtgtcatccagttagattttttggtatcattgtaaatggttaaaacgcatgcaaaaagtttacgaaaacaccacattttaaaaactactaattgaccaaaaaatacataaacaaaggctttgacaaagttatacagaaatttattttgatatcaagtgggcagtgatcattcatattggcttctggatctgagactcagcccatacctggcatttgtgaggcttggggcaagaatgcaaaaagaggcccaagtaccctgtgcctaagtatttttgttataaatcatgtcaactgttcaataaaatctgtcccatcctttctaggcagttatttcttcctaatgaccaggaggagagatctgaattcaggttcttgggctcctgagagttctgccctagagtgtggtattatggggagagctggatcctggttcatccctggcttctccctgcacatccaaactcccatccatcctgccactccccccacctttggggcccaggggtgtacctagacaggggggtttgtcctggggagggtggacctgggggaaaggccataagaggccatttagcaggaaatcctggagcattactctgagtagaccctaggtgagaagcagtgggcatatcactttggcctggaaagtgcaaaagcccagagcaggggttcttcttgctcgggcctgatgtaattaaattattttgtacgtccttcattgtggtctaatgcattcaactatccaaattaaatacaatggtgggattttgttgtttgcagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtggtgagtgtcacagagctagaaatgcaaatgggaaagacaggtcttggctttctgtttcaggtaatgcacacacacaaaattgaatttaatctatgcagtgttctaaatttaaagggaactcaaatcatgtacagttctccctgccctgttatggtaacagtgcaaacctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacagtaaatgagaatttgaagcatgaggcagtttcaaaatgaggcaacttctgagacttttagaaaagaggtttttttggagaaaaggaggagactagacctttatcagtatcagtaaattcttacacttgaaatgttctgaccagatgtttcaaaagttaaaaaaatgtttaactccatttttcctttgtacatggaaatcagttgcatgcgaacagagcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttatttaaaaaaaaaaaaaaactcttcacaccactcgtgagatagagtcaacaaccaagattcacgtcaatggtacattttgaccaacaggtttccttccccagtgagatcaaaacacatagaaaactggtttcatttggagtctgtgctaaaaaaaagtgaaatttgtgccccaccccaaaaaatataaataaataaatgatgtccaaacttgggagtggatctgccagatctgtttccaactcaaagatttttcaatacataaaaacattgtataatatcctggaggaagctccaaaatagtcacttacacctaaaaaaaaaaattatggcttttaactaaccttgtgaattaccagtctttgaaaaggacagacatggcagacaatagcccacttttattagcacctgttatgctagttcatccatacattaactttgtgatgtatgtcctagtaactttaactcaccagaaaagaaagctgaccctcaggtaaataatttctttcacatttttcagtgccttagtggctaatttttctgactccaaaagtccttgatttttttctcttttttaattttgccctaaaatgaattgtttctttgtctcatgcaagttttaatgattcagattttcacctgacagtttttggtttcatttaacctaattcaggctttcttagccttggtactattgacattttaggctggataattctttgctggaagagtgggagcttgtcccgtgcattgtgggaagcttagccacatccctaacctctacccatgaggtgccagcagcattctcccccagttgtgacaatcagaaatgtctccagacattgccagatggctcatggcagagggcaggatcccactcccactgggaaccactaacctagggagagacctaaggaagaggagactccattccagggggagggagggaggagtgaagggttggagagtttactgggtacctgtcatgagtagactcagtgaaaagtgaggtaggagagaatgcaaacacctccaacccagacctaaagattatgtagctcttcaaaagtcatcgcatgacaggtaggaatagctaatggaagagcacgttaggccagtttcaatgcagaaaaggattcttagagagcagaagtcagataaatagaacagactttgtcactagctctagtagaatttgacataaggtaaggttacccaaagacctgcataggataattttattcatatactatgaaagttcttttgatatacctcatgtgttggaaaagggctttgatgaattaacttcacttgtggattgagccttctagttcaatccacaaacatttaacacgttgtatgtgctggacactgagggatgccagaagagcaggtgacagccacagtccctgcccttgacgtacctcggtctagtagggaaacacataatcccacactatgattatactccttgggaagtgtcttgttagaggggtggctcattagcactgcagaagcacagagggaaaccctgcctgagggagggatgtgtgcatatttattatcttaacgtttatactgcatcaccaaatgttttatcacatattttaggataagcaaattcggtaatattaattttccgggcagagagacattagatgaaacatgcggggcaaagtgtatgggaaaccagaagcacggccaagagtggtgaccatagagaattcctatagcagcacacacacaattttatttgacagtatttaattatgctcacaattgcattaccttcaacgtagatcctttatgcagaggatctactacagtggtattgcccctcccacacttgttaaacatgtgatatgtctctggttggttgtttgtaggacatttaagtgatttaacacttcgcctcttcaccttttaaatttaataattcttttcctcaagttgacctatccatatcctattccagacctacttttcttagagctgtgtggttgtgtgactcactttcggaacgtcggcctacctagtggggcaagtttggtttatgatgatatgtccaaggaatttttgtagtcttaggctcaacctagaatgatttgtactgtcatattccattcaaggttatctaggatactaccttctcccactcatttatactcaaacactttgcagtaaactttcatacttcctcattctctcctaggccacagcccaatgcagtcaatcaccgagttatatgaggtctcgataatattttgtacatttctaactgcattagaattcagacccccatcaccttgattcagagaactaaatctggtagttttacttctagcagcactcccttccaatttattcttaacactgtcattagtaaagctgttacaaacgtagtatcttgcccatcagcccacctttgctccactgagtacacaagtccccagattactttcctcaagttatccttcgcattgctagtgtacatccttcagcagcagccaaagtcctctccttttctagaggcccatggtcacccctgcccccagatctttgtttctagcatccctttcttctgctgggcattgtgtctttttccaacccaagtacttagagtgccatgcgtagtgagtgcctggagggtggtattgattagttttacccccattattggattgcttgacctgtttcccagctgagggatttactggacaggtatgctcatcttattttctgagattgtctgatatccacaggttagattagtaatactcagacagaattagggagaaacattctaaaaatgttcaaattattttcatggatattcttgagattggttgctaaaagtctgtagtatcttactgttgaatccatcactctgttggtgacatttacatgaattctgagacatatcaactcaagtcttaggaaatctgggaatatgcatttttaaatttttcctgttgaggttttaggaaacatttactatatgactaaccattcctagttagaacccttttcagtcagggcagaaccaccctcagaggatgttaggaaatgtttgggttctgtattcgtttgctcaggcagttataacaagttaccacagactgcgtggcttaaaacgcagaaacttggccaggcacagtggctcacacctgtaatcccagcactttgggaggctgaggcgggtggatcacgaggtcaggagtttgagaccagcctgaccaacatgatgaaaccctgtctctactaaaaatacaaaaattagccaggcgtggtggtacacacctgtaatcccacctactcaggaggctgaggcaggagaatcgcttgaacccgggaggtgaaggttgcagtgagccgagatcacaccagagatgcactccagccttggctacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgcttgcaatatgtcagagagacctccacaggaaaaattgttctaccccaaatgcccggagcaacccctacaagaagtacggctaacgaatactttgtgtcttgtatttatcctcatattgcttccttatttttttttttttttgtcacatgtgagtcaaattgttcagaaaattagcccaactgatgtattctataaaataaatgtctgaaatatttcttaaattgtttcctagatacaccctccgtggacttggaaatgatcgatgtgcacgttttggctgacgctttcaaacgctatctcctggacttaccaaatcctgtcattccagcagccgtttacagtgaaatgatttctttagctccaggtttgttttttctcttctgggaacctcattgaacatacatggagatgtagaggtgcttgtatatgtcttgcatatatagaaatagtggttagaaaatagtagtaataacctgtccctcccccaacaataccacctcaaatttcctcctccacccaagcatccaagagaagacccagattctcatttgcttgggaagcccgtctgcatgtcagaatcagaaatggctcattgttaacctattggtcttaacaaagtttgtacgtcaatgaaggacacggtcttccaagtactagtgtcagattcaaggaactgggactagaatccagtgatgggggatgttcttgtcatctttcctgagtggccataacagaatgtgttgagggaagatggctctcagttttaggagataaggttcagttaagtgctttggggacaggaaactggttcgtaaccttcaaagttaaaacctgtgatacttatctgatgctcctctgagttagccaatcacacttgaagctgctcaatactgggtaagttgctgccagcacaccctgaacagcttgtggtttctttacacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccaggtaagtgaaaggagacaaacatgtattttggggtgatgagggtagtcctaaatggattggtcatgaaaatgtattctgaatatactactccagagatgcatgtgcagatgctatcacacacattcacttgagtgtatataaatgaaaatgagtttgcttttagggaaaaggtttctaataaactctctttcttacagctctgataatactgaaaacctcataaaagttatagaaattttaatctcaactgaatggaatgaacgacagcctgcaccaggtaatgctttttgagcatttaacattctctcattgttcattttttagagccttaaaaaatgatggctataaacctcctttgaagtaacacagcttcttatggaattacagttggtagtaatatgttaccttgtgatttaaagaaaaaatagctgagtggtagtgtatatgttaattattatccgagtttcaacatttgtggattttaaattatcttggttttaggtgagagtttggagagttccctgtacccttcaacatttatgcttcaggttgttgaagagatttatggagttcattttagttgttgacatttttgtttttctttctaatacttacaaagtaggggatttataattactatataatttaaagtattttagaatgtgttttttggaagtgggtatgctgagaaatgcctgtcaaaataaacattttcaataatgcaagcagtatgaaaccagtgttccctgcagcaagttcgagcaagccagacacttctttgaaagcaggctgctgttcagttagccatttaacaaagcaggaaatgtagaccatgttagcaatgcatttaatttaaactgatgtatttttcttctaccgtggaaagtctaaacaacctcattttgctatataccagttaaaagttagctaatcgacactggtcatttagaatagtaattagggtactatacgtgtgaagtttcaggaccagtaaaaggtgttgcttgtagtcttaatttatgcctggaacttaaaatgaaactccatgaatatatttattataggtaatatatgcagattaccatatttatctctgtatgagcaggcatggggactcagtttcatcttcatgcaatggagagttaagttgtgctttttcttaattgggtattgcacagccaggcttggttacttgcatctggatggggcagcctaagagaggccagggcctagactcaaaacccacctgcagcaggtaggatagaggatagggtaggtaaacactgaagatgcgggtattgggaaaggtttatgtggacaggcccaaaatgtaccaaaggtgagagagaggtatccggtatagtagataaggcaagcatgggatgttccaaatcacagcaagcagaatgttttaacaggggtgcccagaattctaggtaaactacgtcaaagaagactgtcaacaggtagggactaggacttcagtccaggggttggccaaaaggcttcatctcgtgtgagtacacaggtcactgtgaatggatttgggagctctgtgctggtgttcagaggctgcctttggacttagtggaaaagaattggggtaggggtgtggcacatggcacttaagttgaggtttatgttagagactaggtagagctggaccctgctctcagtgaagggctagtgggtagtcctgatcttttcagtggccactcctctagagagaggagacacatggaagccaaagccagacagggtttgacagatacccacaaatgaatttatcacatggaattttggagaatttctactacacaaggtatagcagaatcagtggtagagtttgattagcctgactggtgtaaactagttaaacgcctttgttagtttcatcctaattccaccaaagtaaaaacgggtatctgcactattttcataatgccacccggaaagctgtttgatatgtcaaaggaccctacatttctctgctgagcaattggtgcgcctgtttcaaaggaggattagttccatcagctctgctaaaggatgacaaagccttgaacatttgctagatcatcccagtatttatgtggcctcttaaaaaaaattaaatccaagtcggttttaaactctagtttgagccgttttcccaggaagtttgtgtgatttgtataggacctttggaattaaatggctgttttagtgtctctcatgtgtgcatacattgtactgcccactccaggaacaaaacgtccccatccagaacatcttcgtattcaggaatggctccagtgcaaatgactgctatggcagcctgggttgaagaaatgattcttaggcctggtttaaaaaatgcaataatttcttagagtccttcagcattgccacagcatgtgctagtaccagacagaactttgaaagcacagcaccttacatctccagcgaatggccatttacagtaacattgttgtgaacacaaatgagtacctgaatgatgtttaagggagacaaaagcaagactctgttatagggcagatagacagcatttctaattattaccagatagaacttgaaatgacaaagcttatgatgtttgaggcaaagtatcagttcaaataagagccattagcacatagtatctaattaaatgctaggtgggagtacacatactctaagtacaaaaagaactttagaaatgcagctggtgactttctagggtaatggagtagacagaaaaggctcatagaagaaatagggcttgaaatgtgccttgaagaataggtacaatttgaataggcaaaggagaaatagcattttgatgcatggagtttaaagacttattcaaaataaattacacagtacaaaataatggcttggtattttacaaaagcagtacatattttaagtgatagtatcacaaaaaacatcattttagagttgaaagcattgtccagctttaccaatttggacatgaggaaaccgaggcccacagatagaggttcgctctgtgctacccggccagtatgggcccaaaccgggtctgcccaggagccgcctcctacactccagcccattctatctgccatgccctgctgcctggatttttggaaacttcgtgagcaatgaggctgcttttagtgtccaatcaaaaactcctctgaagtttccagcatgtaataaactaaaaatatgtgaaattagcccccatgggtcacatatagtaaacaaagtcagggcaatgtttatacttttcaggataaggctccaaatcactccatgagctgtgcagtggaaaaaaaagtgggcttctgactcaaatagatctggattggaatctcaactctctcgagtaactcagcttttccaaattgttttccagactgtggaattgggttaatgcctctctcctggggttggtatgagatttaatgaactgataatttctctgctatctatcgcatcaactctagcttttgaggccttatgggagctgtcctcattcagcaggtctgattccttcagtccacccattcctcattagttgtgtgaatcctgtcaggcctttttccttactgacgccatgttcccagccagcagagctacggcctctaggagcctgtaggggctaaaagggacacttgggaagttgccaccctgatgtgggtacattgcttggagggagaaaggtgcctttgtatgaatatgtggcttggtgaatggagcagcctagatttcatcaccactcctccatcttgcctaggtgcctttgcacagtgcacaaaatatgcaaccatacgtcgctgccccaagcagtgccatccactttatctgcactcaagtaggtccttcccgttttatatgcaagttaagtcgacccattcagtatgtttatgcctttaagcttcctgtcaccttatgtttaactgtctatagtttttcctattcatctgcttaattacatttctaaagggtaggggtaaaggctttttctccttttgagctcttcctagcagagaactaggtacagcataataattatctaaatttttctttgataaacttccaactttcaaagaatagtaatacatcaacacatctaatacatccagcaatcctgggaaataaggattctcctcatttacagagggaagctaagatttggaaaaggtagggcacagagtaagctctctagactttgttgatagtttgctgttctattttgttactaaaaagtcttaacttgtcgtttggctttcaatatttttttcttgaatcattgtgttatctttacccaattaatgcttaggcaggtaaagtagatttctgtaggcaaaccaaggtaaaaataagtctatttaacacagggtgcctttgaatgaaacccattataagtgtatttacatatttcagatttcatggatatattcagaaatattaatgtaatataattgaagtctaatattgcaccctcaagcccagagtggaaaataaatgactctttctaccccttgcccttctacacctgtcaaagttaatttttaaccactggcacattgcaaaacattcatcctgaagagcctgattcataaatcttgttttaaatgctctgggcttggttctcaacccagactaaaggcaagcactaaggtagagggaaatgacattcaaagagttttacttgtctctgatttaatttttattggtttaaaatgtggtctgacattagagggttgcttcaaaggtgaaaaatgaaactttgaaaaattacatgtttgtagatgcgtagaactaaacgggcaagccacactaggttttgtcaaacaatagttttatttgtgtcctgagagacacaggtattttggtatgtatgtgtttaggaggggtatatagtcagttttacttttgttttcacagtgcagatgtctctttgtctcaagggacaaagatctgagggagaattgcaggggggactactttattctgctaagcagtggggatgcctttatcagaaacctggtagaatgtgtcagagtttatacatacgtaaacctgggcttatttatatacttaaatggatgttttccttagcataatgtcagttaagaccagtggatatggagcaaataatttgaattaccctaaaaggccctctgttctaagttgtcttaagttaaaattatgaagagaggtattcattttacccttagatgaagattttggttaatttttgttgtctattctttttttcatggtctttgttcataaatgatgtccagaaaaagaagaagttttctaggttgaaagctgcttgtgcaacatttgccacttgatggtgacttgtacatatgaaatatagtattcagtttgtaacttttgaacagtttaaggatcaagagacattttcctaactatatctgctgagaagtgaaacaatgggctgtatttgcctctgaaatgagttttacgaaactttgaggaaagggagaatgatacatattgttttaaagaatccagaaggtaaagttagttttccagtgtgtctaggcctttgaggtcccagagaaatgctgacattaaaataaaagttttcctacaacactagcagcttcgtgaaaactgtacttttgatttactaattagtgagtcatatagatcaagtgacagtaatacaattatgtacattagttggtgtcaaatttggacatacgaaatatacagaaagttgatggttttctcccaaagcaggaattactgattcagttctaccagcagagggctcccttttttaagctaataaagaacatgtgtcttgcagatcactttttaaacactaaaattcaacgggaaaaagattcagctcacactttcctaatataataggacctctttggtagatgattgtacatattgtgagaaatttgtttaaggcaaagtttttccaatctatttcaagactttctatacgttgagagagtactgctttccagtggcttattttcttctgaaacagaaaatatactggtggacttaacagagcattttaatcttagaaggttttgacatgaaacatcatgtgaatccagacaggtatgcttaggagactgatgtttccaatgtttctagctttagaaaggctatttttaaaagtagggcaagattatgcagctcaggatgcaagggtattctctgaactaaccatatgtccctatgatcagatggcagattcacttatagactgttatttccattgggaaagtttttcaatattatatcagttgcactaaaggaaagtttgtaaaatcactttcattgtgggtttaacagcactttccagatatttcaagtaaccctgaagctagttgctgctgttggcctgtgtggactttatgtgaccactggatcactttcccatgcagagtatgagggtattattgaaagaacctatgtcttcaaagggaatgaaatgttttgttttaatttaagcaagctaaaaatagaaaacagaaaaaaccagagttttgttaggggtgtgaaattttttgcatgtggcttaaaagattaacttcagttttgtccatttttttttacgttctctagcaaagggaagtgaggagcagggacaatgggtagagaagggcatttgaaaccatcagaagattgggttctagtcttagggctataatcttctgtaaaccacttcacctccctgggtcagatttcgttttcccctctatggcatgcaggaattgattgaagtgaactctaaattactttctggtgtaaagtttggtgatttccctggataaccttaaagctatctatgctcatgcaactgaaaattttcttagatcaaattttaattaaatagtagtcagtaatcccaagtctggtccattgccactttctcaaataaagggcaaacatccgcttagaaaggtatgcccttctctgcccttctatcctttaccccattagctggcacataaacctaatgcagagacaccttttaattagcaggtcatatggccatttaaatgcgagttgcaatcgacctcataaaaatagccgcagtgttgttttattctgaatcgtcacatgatcatggagtatagtatgcatatggtgtggggtttaatattcgtccgaggatgccctcctactacttactattgaacatttttgtaatctcctccctgcccgagttgctcacaagggctttcctgttacacctgcagggctgtctgtgctggtgtgtgggaggaggtgcaagaggtggacacgagcgaggcgctgtgttctgggttgttccaagaggttcaggcctttacaagtgaggctttgattctattttttgctgaactagctcagccacttcctgtgtttggctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 1907 - DNA, 13398 bp, Homo sapiens
agcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 1908 - DNA, 11183 bp, Homo sapiens
taggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 1909 - DNA, 9254 bp, Homo sapiens
attattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaa

SEQ ID NO: 1910 - DNA, 179001 bp, Homo sapiens
agtagcgagcgccggcggcggagggcgtgagcggcgctgagtgacccgagtcgggacgcgggctgcgcgcgcgggaccccggagcccaaacccggggcaggcgggcagctgtgcccgggcggcacggccaggtgagctgcccggccgggagcgaggcaggcagggcgcccagggacctgcgccccgcggggaccggctcccagggcgctgcgtccgagggggtctgcgtcctggctcagccggagcgggcagggacggggcgcaccctcggggaccccggcccgccgtgcccggggtccgtttggtgacggcagggatcctggcccagccgctggccacttcctcaccccgggccggcgccacctctccggtccgtgcggtggggcggccccagctttgaatggggaccgggaggaaggtcaggggtcgtgtgggggctggcgttcaaaactcctcttttcgagcggctctgcgtggggtggcgccgtctctcttgacggcccttgtgcccagagctcgcggacgctcggagccacacttccctgtctcacttcggtggttgcgggtggcgggtgggagcgataccgcgggaggcgcagtccttcccggagacttttggagagcttgcaggacactcgcgatgcccgctccgcagctgtctgcgtaattatgcgtgtgtctgtgcgtgttgtgttttgttgtgttttggaatcccaaagagggcattacccgcacagcgcaagagttcaggttaaagacgtgccccgtttggacggggagctcctggattccagcaggacggtggggcggggctctcttggtaccctaatcttgaactagggtgagaaactatggggggcggggtggtaaaggggtgacatggcgcgagggaaacaggtggccttgcccgtcggaacttaatttgaatttcagttccatcagtgggaccctgggcaagttgaagaacctttttgagtctgtttccccctctggatactggagccacccaattttccagggctgtgtcgagaattggggcttattgctgttccacgaggttcgctgagaatcggggcgcatccatggagagtccttgggcagttcctgactctctggttcaagggcattctctggggcatgggccctcgtccttgactacagttctgcggggaagttttacagaattttgaagtctatgccagcctcaagcagtttctcttgcaaaggtgtgtgtgcagtcacgtgtataccagctcagggacaatcgtcattgtgagcctcactgatgtttaagtcacctaatgatgcagctgccttcccccaccagcgactggagtatgggcagttcctctggaagtggaaaagcacagaccccatgaatagcccttttgcactcattgggtagagtcaatgaaaagctgctggtgagaaaacttttgaaaacatttcttggtcaggcacggtggctcacacctgtaatcccagcactttgggaggccgagctgggctgatcacttgaggtcaagcgttccagaccagcctcaccaacatggtgaaaccccatctctactaaaactacaaaaattacctgggcgtggtggtggccgcctgtaatcccagctacccaggaggctgaggcaggagaatcacttgaacccaggaggtggaggttgcagtgaacccagatcatgccactgcactccagcctgggtgacaagagagactccatctcaagacaaacaaacaaacaaacaaacacacacaaacacttcttaatttagaaaacagcaagaacacaaagagaaaaatttgcccgttacatcatcagttaatataaataaagtcaagttgtatcctctaccctctcccagcctccgataaatagtaaccactctcctggatttaccagaagatcacctttataaaaagggaattgtattatactcatacagttgcaactattgtctgaagctatttttttattgacctcacaaatctttccagatcaaattgcttatctatcatcctcattctttctgatggctactgagcgttcttcagtgcatgtgcaccattatttatccaggaggccccccacattgatgagcagttgttttctgtttttttttctttttttgtatttctattgcaactattgcttccgtgattttctgtcgtacatattgcatctttgtgcatgtctttctttacatgtacaattgcaggatcgaagcatatgcgtgttttgctttttagtagctgctcacaggttgccctaaaggagcaggggtggaatttacactctcacttgcagtggctgacaccattcctttgaaaatagtgtattccctctaatgctgcagggtgggtgtaaggtgcagcagtaatgtcccttgaactgttggaggggcccttaccactcaagtatttgcctgtgctccattttaacacaattgtcttgtgggatttttggatgaaatcctgtactggcttaccatgcacagagcactgaagagacaaaaacttccttgatttctggttttgggtcctcgcatctcatttcatgtcctttccccccccccccccgcccgcccccgagacggagtcttgctctgtcgcccaggctggagtgcagtggcgcgatctcggctcactgcaagctccgcctcccgggttcacgcctttctcctgcctcagcctcacgagtagctgggattacaggcatgtgccaccacacccggctaattgttttgtatttttttttagtagagacggggtttcatcgtgttagccaggatggtcttgatctcctgacctcatgatccgcccacctcggcctcccaaagtgctggaattacagtcataagccaccgtgcctggcccattttatgcctttctaaataagcttatgagatacaagaacatgaatgagcttatgagatacaagaaaaacctttagaaggacatgaaatgtaaaaatggcaaaaatcagttattcaaactcagccatatttgtatttacaaaataagtcattttatagaattacccattaagaatgggaaacaggaacaaaaaagggatttcaaggcttttttttttctttttttgaaaaaaccaaaaaaagcagaagcaaaatggaagttgctgtggtggctggtgctctctcctgggctcaaggtcttggagacctccctgccatagttgataaagcgtggaacgctggagacctgagctgggtgctggcaggatttgaatggtggactccagggatcttttggccgtgaagatctgtttccaattgcatctcataagctcattcatgttcttgtatctcacaagcttatttagaagggcatttcgtgagatacaagaaccccaaaccagaaatcaaggaagtttttctcttcagtgctctgtgcatgttaagccagtacaggatttcatccaaaatcccacaaaacgattctgttaaaatggggcacaggcaaatacttgagtggtaagggcccctccaacagttgaatggacattactgctgcaccttacacccaccctgcagcatcagaggggatacagtgttttcaaaggaacggtgtcagccactgcaggtgagagtgtaaattccacccctgctcctttagggcaacctgtgagcagctattacaaagcaattggtgagacgcagcatggaagtctggtgtttatggctgagttgatccactgggcttcgaagctggaagtaactgggaccctggggaaggttaagtccaaggccctcccagagtgagggctggaaagaactgaggagcctggtcccttgtcctggtttctgtctaattgaaggtgttataatggggcttgtgtttcctacttatgttccagtggactatggcctagagacctgggagtggggaactccaggatgcatggctgggaacagtcaacatagtgaagagctctgtggttggcagctgggtcaaatccagtttcagctacttttttaaaattttattattatattattattatgctttaagttttagggtacatgtgcacaacgtgcaggtttgttacatatatatacacgtgccatgttggtgtgctgcacccattaactcgttttgctactttctatctgtgtgacctcggataagtcccttaacctcttttgagagtggcaagtactggcaaatcagttaatatctggccagatgctgccacaggattctggactaggggcttgggactcaggtgagggttttgatctttgtgctgctgctggtctacatgactttgatcaagtaatgtgacctcttgggatttcagttttccgctgccgtatttcccattgagataaatgagacgaaccagacacaacaggtgcttggcacctggggaagggcccaataaatggctgcttaacaaggatgaaatggaccatgggggcaccttgttcatccctttgtcctggctaatgatcaggaggtcattttgggtttctcctgataaggtaagatgcacattaactctcagcagggtttttttttagcatactctgttctgcctcctagcctttgcttaaacttaaagccagttcctcctgcttcatcttttttgaaagattgagttcagatgcctgcttttttcccctgaaagctttttctgagccctttaagtgcctagccacactccagattaaatttaggattccttcttgctgctctctgcccgccgtgcccccagtgcatgcttctgctgctgcacttgtaactacattagaattctcagttgattagtctgtttccccatgggcagagagcaggtgtaattatctcctgctgctggcatggctgaccgaggaggtccctttggtatgggtgtgcagtagagggaggtgggggcaaagggcaaatcctgggcccctccccattcccctcatttgcatcctagtccccacctcagtgcctggcatagagttgacatttgattaatgccttccccaatggctgattaatgctaactgagaccctggtaaatgctgcaggctgtgcatacattgtagctttttgtcttcccagctgccccttgtgggcatttaacctccattttacagatgagggaaccgagccacagatttagagcagcttggcagaaggctgagcccggctggaagcacagacagccctggctgaacaccagcctctcactcctccttctttggatcctgggagggtctctctagtgctactctgtaaccttgagagctacagagtaacaactccaggcacctccagggacttggagggaaaggaggagataagaaacagaacaaataatggtaattttaacaatagcttaatctaaggagtgctgactttgtatcattgttttaagggcctgagatacattatcttgtttaagccttacaaaaacatttagatggtggatactgttaccttcttttatgggactggaaatgagcccagaggatctaagtgacttcttgcagcctagctggcaagggggtccctggtggttcagctccagggcctggggagcgccttcactctaagtcctattttgggggcaggcaatgtgtttctggggatttgggaggcagaatgagggaatggtacagagtgagggctcagggagggactaagggattttgagcagaggagtgacatgatttgattcatgttctaaaaggatccttctggctctgcatctgagaattgaccctagcaggtcagggaagaagtggggagagcaggattagaatagttcaagtatgagatcctaggaggagccggtgaaagggtgagatgcgttggaagtggtcgtgagagagtccacgcaaggattcctccaaggttttgggcccaagcacctctctgacactgaccacccacaagcataaacagcaatcaaggacacctcctaggtgctggccgtcaccccaggtgctttgctggggcatttctgaacactcccattttaaaaaggctaaaactgaggcacagagaggtcaagcagtctacccagagctacacagtcagcaggaaccttctctagggtttgaacgtgaagctgccaagacctgacatttcctgcctttcatcctcatttctatgcagaggaaccatttgccaaagtctccatggatgattctgaaggtttagtttgtttttcgtttatttcattttttttttttttttgttcttaattttgctcaggaataaagagatggttagaaatctctagacaggatagagaaggatgttggagattaggggtgagaggtgggagccaggctgggctgctttggctattcaaatattctttaggataagagtgggtggggagagaggggactcactgccaggtcagggtgatttggttattcaaagcccacgtaacggttgggtccttgaggtcaggggctcttctcacacttcagtttccatttaaacctttgtgtcctgccttagctctctgagtggccagcgatgccttgccactagaaccttctcctaaaactcatcctgattgacatgagacaggattttggttcctgaagttcatgccctgttaactaaacccctttcagtactaaaatcagttcactctttaattctgccctttcagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttctgtgagtactcgctgggtggggcagtgtggcccgtcctctggggccctggcctgagcacctgtccaccttcctgtcttgtcattactgtgattgttgttggtttgatgtgttcttttattcgtcttaaaatgaaagcattgccagtttgtgtggatctctgatgaggtttacaccaggtggaggaagttcagctgggaaaactctggtgaaagaactgaagctgaggtcagccaacatggaaatggcattcaggcagctctccttgcctggtggttctgtgccctgtctgacagcatcagggatcgtctggttcccacaactggtcgagtcatctttcctcttaagggcgaattagcccaagcctgcagaaactcatagcttggtcgccaaatgctaccttgttttactgcataccatagcagtgaggggcctttgctttagtctccaagcagggagagtgagttgttgaacgttttgtagctttcaaatgcaggtctggtcttggtagaggtgtccctcctcccctacctccgtttgattgggcagctggttcagatcctaaagtttctaagactgtttttaacaaatagagtaaaggcacttaagcaattttcagttgcaaatatttgctctaatttgtgtttttaaattaactagtttttaattgaaatatatattcctgggggttaaggagtcaactcaaatatttctcctccctaaaccatcctactgaggcaagctcattaccagttacttttatcttccaaaatagtctatgcttgcataatgtgtgggtttaaaaagaaaacaattgggaactcttgtacacttctgcaccttgacttctttttgttaattaataatgatgttggcggtggtttcttatcagcacacattgatctcattctttcttggacacatgacatgtaatggcacaggcctcaatgtaacagtttaactccagagaagggcatttcatgctatttccaggcttttgttattattcgaagtgactatcattgtactcttttttttttaaaacaaaattaatttttttgagacaaggtctctttcttttacccaggctggagtgcaatggcatgatcatggctcactgcagcctcagccccctgggctcaagtgatcttcctgcctcagtctcccaagtagctgggaccatgggaatgcaccgccatgcctggataatttaattttttttttttttttttgtagagatgggatctcactatgtccaggcttgtctccaattcctgtgctcaagtgatcctccctccttggcctcccaaagcattgggattacaggcatgagccacctcacccagccttgcactctttttttttttttttataatagattgattgagacataattcacatagtatacatagaattcacccattgtatgcagcatgtatagtgtggtggttttagtatatttatataaatgtgcaagcaccactccaatcaaaagtagaacctttatatcacctcaagatgaaaccccatacctttcaccatcaccccatcccctcatcccccctaccagacgtaagcaaccgttaaatttaattctgtttctataaacctctctattctggacatttcatagaaatggatcctatgtatgtgggcttttgtgactggcttctttgactcagcatttttcaaggttcatccactttgttgcgtggatcagaaattttcctttttgtggcagaatcacgatacgttgtatgggtattccacagtttattcagtcatctgttgacggacccttgggttgttgccaccttttggctaatataaatagtgctgctaagaatgtttctctacaagtttttgtgtggatgtctgtttttatttgttttgggtatatacctaggagtggaattgctgggtcatacactaactcagtttcatcattttaggaactgtcagactgttttctaaagtggctgcaccatttatattccttccagtggtagaaaagggtgatcgttgcattattcttcatttgtatatatgggtatatctgaaggacagcttcctgaaggtttatttctgagctgaaggatatggcatatatatattttaatagacagagtctcgctctgttgcccaggctggagtgcagtagtacaatgtcagctcactgcaagctccgcctcccggattcatgccattctcctgcctcagcctcccgagtagctgggactacaggcgcccgccaccacgcccggctaattttttgtatttttagtagagacggggtctcactgtgttaggcaggatgggggtatggcatattttaactttaaagggaagtttggcagcaccccacaaaagaggttgcccccactgtctgtttcagccacaggatgtaaaagtacctgttgcctgaaccctcatctatgctgcgtggctgctgaacttggccatccacaggtagactttggtagcttggtgtcatccttaatttgatgtatcctatcatgagtgtgatcaaactgctttctgaaaggcttttcctggttttggagcccagtgggtctcttgtggcacagagccagagccctgctttggaactgcccatgtggaggtggccatcttccctcttgactgtttgcattggccggctccacccccaggtggcccagaaacctgttgcagctggggtggccaccctcccttcccccacaaggggtgagagggttggcactgatggtaaatacagatgggccacgttgagactggactgcaggttgttcctttctcttctcaacctgcccatcccaaacctagctgcccatcagaaacacccaggggggatcttgtaagtatagggtattaaccatggcatgtgtatacacctgtgtaacaaacctgcatgctcttcacatgtatcccggaacttaaagtaaaataaaataaaataaatatatacaaaaaagaaattacagggtattagaaccttcttctgaagctcattgtgatgggcatgagacaggattttggcttgaaatctatgccctgtcattctccccttctgctgagtaataccatttcactcgcttacgcggatgcgctctctcgctctctgttttagagacagggtcttgctctgttgcccaggctagagagcaatggcctgatcatggttcactatagttgtgaactcctgggctcaagtgatcctcctgcccagtctcccaagtagctgagactacaggtgagtgccaccatgcctggctgattttttaacttttgtgtagatagggtcttgctatgttgccgaggctggtctccaactcctggcctcaagtgatcctcccaccttggtctccgaaagtgctgggattacagacaggaactaccatgcccggcctcaattcattcttttatttatctgttcagcctctttatttccttcttctttctccctggagagaccaagaatgatgatatttcaccactttggctggggcgtattattataataagtcccccggatggtctggtaactaggcaggtttcacacatatgccactggagagacactgcccttcctccaccttccccctcctctccctcctcttctccctcccactttccctttctttctccttcccttcccacctttgccccccctccattgcctcccctctgtcatttggatgcccactgtaggcgccgccctaggcgctagagatacagcagttattaaattggattcaaatctccgtggagcctatattgctttattaggtatgagcagtctggggcttgacttccagtgcccttggatgagctttgctgtgtgatcttgggcaagttacctccactctctgaactttaattcccttatctgtggactggaaataacattggtgtctaccccacaggctcatggttgggaagaagcaaatgagaagatgcattggagaggctcggctgaattcatagtgtgtgacaggcactcagttgttgggaaccaccactttcaggatgtttgctgttgttgctaactagtggagtccagcctatgtagtcttccttaggggtttggactggaggggagtagggtccattctcaggttttcagaagagggatgacgtgattggatttgcatctttgagcatgcagtggaggtcctgtttgcaatgatggtgttggtaaagtgacagggaaagccaattatgtgtgaagagcttagaaatggtgcttctccctcacaccttgagagagcaggccttcaggccctgggtggggactgtcagtgtcaccgctcagtctcctgctgagaagggtgacgttttatctcaagaagaactcccagctctggcaatttcctcacggggttctggttagcaggaacttgctggttactgtggggtctgcaggggcaggtgcacatgagaggagcaccggcacctggttttggaatagttggcaaatggtgtgtgacttttggacaggtgttacaatccctgtgcagacctgggtaaaatacctaggtcctactgtctaaagcagcgtgtggttctcaaccagggtgatttttgcctctccctccctactccagggtagggggcatttggcaaagtctggagacgtgttgattttctcacctgggatacagggtgctactggcatctagtgtgtagaggccagagaggctgttaaatgttctgtagtgcacaggacagtccgcaccacagagagtgatccagcaaacgtgtcagtggtgcaggggttgagaaactgctctagagtcatgtgtttgctttgctcacagcaataaaatgtcactgggtaaaatagggttttgctctgaaccctgtttggatggaattttctcatttgttcagcacatgtttgccatcatattgagtgctaaactctgcagagagagggaggaggaggatggagtcccagcttgcaagagggggagacagactcaaacttgcccttgcaagattgtgtgcttagtaccatagcaggagttttcactggatgtggtgtgaggagggaaggtttttgtccatttggatgtgggggaggtggtgaggaatggggagggctcattgtggaggagctgcttgggtggagtttagagagatttgctagatggttagcagggatggctgccctgatcctgtgggattaatgggtgtcatgtaatataaacaagcagatttgtgggtcatagatctgggcagagctcagctgggcaattcttctactctttgtagcctggactgaggtcatttggtgtcacctcgcctggaaggttccagaatcttcactcacacatctgataccttagtggtgatggctggaagactgagcttagctgggattattttttgtttgtttgtttttcagacggaatctctgtcacccaggctggagtgcaatggtgcagcctcggctcactgcaacctttgcctcctgggttcaagctattctcccacctcagccccccgagtagctgggattacaggtgggtaccatcacatgcagctaatttttgtatttttagtagagatgggctttcaccatgttggccaggctggtcttgagctcctgacctctcgtgatctgcccaccctggcctcccaaagtgctgggattacaggcatgaaccactgcacccagccttagctgggactgttgaccaaacatctaccatgtggtggtctcaggcagaagagtcccaggcagaagctacaggcttcttacgacagcctcataaatccgaggacatcacttgcaccaactcagatcagcaagcccagctcagcttcaaggaaaggaaatttctctcttagagaaggaatggcatgcatatcgatggtaggcaggaactgatggtggccaccagcagccaagctcccacatgagcatgtcgactctgaatcccaatttatgatgcaaatccctgctctgccactgtattagtccattcttatggtgctaataaagacatactccagcctgggcacagtggctcacacctgtaatcccaggactttgggaggccaaggcaaatggaccacctggggtcaggagttcgagaccagcctagccaacatggcgaagccccatctctactaaaaatattaaaattggctgggtgtagtggcacatgcctgtagtcccagctacttgggaggctgaggcacagaattgcttgaatgtgcaaggcggaggctgcagtgagccgagatcactccactgcactccagcctgggtgacagagcaaggctctgtctcaaaaaaaaaaaaaaaaaaaaaaaaaaaaaaagacaaaacaaaacaaaaacaagcaaacaaaacccaagactgagtaatttataaaggaaagaggtttaattgactcacacacaatatggctggggaggcctcaggaaacttacaatcatggtggaaggagaagccttcttcacatggtggcagcaaggagaaggagagctgagtgaagggggaagcctcttgtaaaactatcagccctcatgagaatttactcactatcacgagaacagcatggaggtaaccggccctatgattcaattacctcccactgggtccctcctatgacacatgaggattatgggaacgacaatttaagatgagatttgggtggggagagagccagaccatatcagccacttactagaagtgtgactggaagctaattcttttgttatatttctgtgcctcagtttccatatctgtcaagtgagataatagtagtttctatcttattgggtgagaattaaatggattttattttatgttctttttaagatgtgggaaatattgcataatcgaaacttaatacaataagaccagaaagaaaaaaggccccctggtgaggacccccaaggcctggcctctggcagagaagactgagtctgaagcacaacacctcacttcctggcctccaggttccctattgctttccaggggtgttggataagatggtgctgggattccttccatccccagccttctgcatagagttaaggagctggttgtctgtgaatgtcgggagggagcttgtggtactgttgggcatgttggttttctttcctttctgagggacctagttgagcagtcttcaggtgggaaggggtctgctctggggcctttctgagttgagccttaggtgtcctcttgcatcttgtgcatttgaaaggcttggattttgtctcaggagccgatgtggtgccacctgtttgtgggtctggaattttagggtcggctgtggtgatgggcccttttgagggcctggatgcgtccatctcaactgtgtaggctttttatcctgacattttcacttttgcttaggcatatcttctctgtctgcttatttgtggcaagtggtggctgcccatgagtgacggattctcaaacatatgagctgtctgtttccttggtattaggttcttggggttcccacttaataatgataatagtgataccgttgatgagagcctcttctaatgaatgctcactgtgtcctagtctctgtgaaggcacatcaaagataactccttaatccccgcagtggtccagtgaagggggagctatccctgctttattcataaagagattgagtcttggggagatgagatgacatgcccaagttaaggaaagggcagagctacaatttgaacttgttcttcccagtttcagtctcaagtcttcttcctgctctgtgttgttttcttctcctaaatgatctcaaagacgtatcagatctgtgtgtcataaacaccctgcctgagaccaaagaatggcagcttcatttagagtttctttgtgacagcaggacagaaacacatgaattccttacgtgtgcagaggacttgctctgccaggtgctggaggtaccaagagaaaggagactcagtgctcatcctagaggcgccggatttgtggggagatgctaggaaaagaccacaaacacagcctggaaaagggctgttggggacaagggtgccgaagtgagagtttactgtattttggctcatcctgaaatccactcttggacttcttttcatggaaaaaatgaatatttttgaaagttattattttatcaaaatgtttttgaaataaatgtgaaattactattaataataataataaatgaattattttctcgctggcatctcctaagaagaaatccattgtctgagggtggtccccaagcccctgcaatgaagcgtctcatcagaaataagacgcaaccaatgcctgaagtgtccataaatgtatttgcctttcagttactggtatgcggtgatggtataaagaagggctgtcaaatcctggtcctgcacttggtaggggtgtgaccttgggtctctcatgtcacctctttgggcctccatttccttatctataaaatgagaatagttgaagaacacaccccataagactcttgtgataagtaaatgacgtgatatatgtaaaatccttcaatagtatctggcacagaggatgtgcttaagtattttttgctcttgctgtcgttgatgtcatcattatcatcatccagcataaaggcaagatggcattgtagaaaggatgggataaatactacattttccatttatatgaggattttccttcctgcacccgatggattgtcctgctccccctggagtatgtgtcctccactttggagcatgccagtgtgaaaagtagagttgacatttttattcttgatggtgctatagcccttctcttatgctgaatagctgaggaattgcttgtcttgttttcaagagttgtcttctatcctggatgacaaccttagaatgttcttagaatttgttcctttgttgatttagcaaatactcaaagaggacctgatgtgtgttgggcaatgtgcttgtcactggggataaagtagtgaacaggaccctgaagatctctagaggatcttacaatcttgtaggaaaagcagaaaaagtcagactaacacattcaatcatgttggatcgtgatagacgctaggaaggaaaggaacagggtactgtaataaggagtcattagtcaggagcactagcctagctggggaaggcctcagggtggcctctctgtagaggtgatgtttgagctgagacttgaagggtgagaaggagggagccatgggaagctctgtggggagagcattctggcatagggcatagcaacaaagctttcctattagtgaaggtagcctaattgcagtaacaagttatttcttcctgtaagtttatctctcactcactcaaatcatgatccagtgggattgggggtgggactctgctgtctgatcacaatgggactctgtgctatcatctccaaaggtgttggaggctaccgcaggatcctttgtgtgaccactgcatggaggaagaggaagagcagaggatggctcaggaggttggaggtttctatgggccatacctgaagtggatgtacctgtttcctcccacctgctttttttttttctccccaagagatggggtcttgcttattgcccaggctggagtacagtggtgtgatcacagctcactgcagccttgaactcctcggatcaagtgatcctcctgctttggcctcccaaagagctgggatcacaggcatgggccactgtgcccggccccctcccaccttctattgaacagaatttggcatgtgaccaagtgcaagggatgctgggaaacatgccctagccgcatgctagaagaacagggcctaagttggggggcatccttccaggcttttctgtaacccctaattttggagggtacagaggcagctctaggtgccccagtgaaggctgataagcaggttgatggtaagggtttgggagtcttgtaggaatccaggagaatgaacagtctcatcgctgggctgcatggaaagggaagtggtgagccactggcactgaggactttcctgtctgtaactagagctgctgatggtgatgtctcttagacagcctcatctgccctcttgggtttctctcacagatgtggccctcccctccccagcacagactgtctccaaaccttggctttttctgttgctgccacatcagtgacagctttggttttgcaacctcccaaggatggacccctgagagagaggcctcctatgggccatgccttttaaagccagcacacatgagcaggctgctttggagatcagtatcctttggcacggccagcctttcctgggcataggggtggattggaggtggtctcctgtaagaggacatcgtctggctcccgggctgtgggcagtggtgggtgcctgttacggattgaattgtccttaccaatttcatatgtcaaggtcctaatccccatactcagaatgtgatcttatttggaaagagggtctttgcagatgtaattagttgagatgaaatcataatggaatagagtgggccctaatccaatatgactggtttccttatgagaagaggagagagagacacagggagagaaggccatgtgaagacagatacagaaatctgagtcatgcatctgcaagctaaggaacaccaggggtgctccctcaggaggaaccagcctcgccaacactttgattttggacttctggtctccagaactgtgagacaaacttctgttgtttcggccatccaatttttggtatttcatgagtggcaggcctaacacacaaatacactctcatgtaacaggggcctgagggcaacggggtgagtacagggattgacctacccattcagccactgatactatggatgggttgtggtttgtcataacggaatttaagaggcgttgctttcttccacgtgtcatgttattttctagctgcgttggttctggcctgggccctgagggtgtaagagggaatacagtgtagtgggtaaacgagggaggcagcatttgtccctcaaaatagcaccaagttctgggaatgcaggtatatttggagttcctgacaagtcagtgcaggtccaacgtcttagggattgtgctgagttgggggagggatctagttaaagatgtcccttggtgaatcatttttgaaaaaaaaaaaattatctccactacctgtcccctagtctgtcttagatataaatgcgggtttttgtatatcaggctcgcaaaattatgtgtcttgatttgtcttgggagagatttaggtgctgtgcagtttggggttgaaatcagaaatcctggggttgacttttcctgctttcatgcaaggcccgatcttggggccaggccttcggtagtcctgacccacagactaagagtgctgggaggccagggaccctgtctgttctgttcataagggggacttcccagcacctggcccatatctggcctgtggctggtgctcctcagatacctggttaacagatgaatcaggaaaaggccctggctgcccctttcagcctcggacttccggtttcttcctaaccatggcagcagtatctggggttgagatagggcacctctgtgacaacttcctctttaaccatacaccgtggttccactcgtggtcctggcacttagtgactgtgtgaccttaggcaatctacttggcctctttgagtctcagttttcttttttcttgtcttttttttttttgagatggagtctcactctgtccccaggctgaagtgcagcggcacaatttcagttcactgcaacctctgcctcccgggttcaagcaattattctgcctcagcctcctgagtagctgggattacaggtaccctccacctcacctggctaatttttgtatttttagtagagatggggttccaccatgttgaccaggctggccttgaacttctgacctcaagtgatctgcctgcattggcctcccaaagtgttgggattacaggtgtgagtcaccgcgcctggcctgagtctcagttttcttatctataagatggggtaatagtggagcttaccccatcagatcactgggaggattcagtttgtaagtgattgtcacaagtccagtatgtacttaacacagggtgcctcccagccatgctgccatatgtctcctcaggcagcaggtgcctgcatttgtgtttgcgtgggggacatgggacaggctgagacatagctcgcatgtgtagggggtgtcctcctcctgctcttctgtagcacacagctaggggtcctctggggttaagtgctcttggacctgagcctggatataaaagcagcccagtgcttctgggaggctggggaggcctgggcttggagaaggagcgtcgacagggtgaaggtgaagttctggaaatagaaacagtgatgataccacatcacagcctgggggccactccactgtcacagggctgttgggaagaagctgtaaggtgctgctttcatctatacaagttgtgctggaggccaggggtaggcgtgagttttgggaggtgaagtatctgtgtgtgtgaaggattctgttttgagaaagaaggaaatgggaacttactaatttgtagaatggaaactagcaaaattaggcaaggcatggtgagagcatgtgcagcaggaagaggagaccccgcagagctcagaagaggtggaggaggggctggcctccccggcctcaggacttcagggatcccactgcgtcttctctgctcctgcttcggctggatttcaccggccaggtgtctctctccccagcactaccagccactccaggatgtccctggcctgccaccagcctccaccagtgggaaaagcccctacaccaggtagtagcatgactgaaggagggcccgtgtccctggggaggcaagaagggcccaagcccagcgtggcgcagagtgaacgttacgccagtttcctgtttagacagctctgagctgcttccctctggccttgcatatttctcctaattaaaacaactgctttttccccctcattatagaagtactatgtgttcattggtagacacattttaacctacttctgggtgagaaaaacaaccccttagcccccgccacccccctacccagagagatggtgttaacacctggtgtaccaccttccaaatctttttgtccaacaaaactttattcacaagacattttcacaacatgcgacccttttgtaatgtactttagtaatctgcctttttcattttgtactactttgtgaccatgttagtattattaactaatttattttagttaatgaattaattaattttttgaggcagggtcttgctctgtcacccaggttggtgtgcagtggtgtgaccataggtcactgtagccttgaactcctggcctcaagagatcctcccatcttggcctcccaaagtgctgggattacaggtgcaagccactgagcctggcctgttattaattttttttttttttttttgagacagagtctcgctctattgcccaggtgcaatggcaccatcttggctcactgcaagctccgcctcccaggttcacaccattctcctgcctcaacctcccgagtagctgggactacaggcgcccgccaccacacttggctaatttttttgtatttttagtggagatggggtttcaccgtgttagccaggatggtctcgatctcctgacctcgtgatcctcccaccttggcctcctaaagtgctgggattacaggtgtgaaccactgagcccagcctgttattaactattttaaatgtcgatgttggtttaaaaaataatatgacagaccccacatactcaagagcaagggatccagggtctgactgcctgggttcagatcttggctatgccacttatcccatttgtggccatggacaagttacttaacttttcattgcactcatctgtaaaataggataataatggtacctattacactggactctcatgaggattaggggagttaattatgtatcatactttgggtatcatagtacctggcaaatatcccaagcactctataagagctactattgctattattattgtttaaatttacttttattgtaagttctgggatacatgtgcagaatgtgtgggatacataggtaagcgtttgccatcgtggcttgctgcacctatcagctcatcacctagatattaagccctgcatgtattagctatttattctgatgctctcctccatccttaccctgctccccaacaggccctggtgtgtgttgttctcctccctgtgtccatgtgttctcattgatcagctcccacttatgattgagaacatgcagtgtttggttttctgttcccgtgttagtttgctgaggatgatggcttccagcttcatctatgtccctgcgaaggacacgatctcgttccgttttatggctgcatagtattccatggtgtatatgtaccatattttctttatccagtctattgttgatgggcatttgggttgattccctatcttcgctattgtgatactattgctattattattattattattattattgttatttccaaccctctatgataggcagaataaacgctctctgctcccaagatgcccttgtcttaatccctggagcctgtgaatatattactctatacggcaaaatgctccttgcagattgaacagatcttgagatggggagatgatcctggattatctgggtggatatgatgaaatcacaaaggtccttgcaggagggaggcaggagggtcagagtcagagtgagactggaagatggcaccagctggctctgaagatggaggaaggggccatgaatcaaggaatgcaggtggcttgtgcaagctggaaaaggcaaaggaactcattctcccctagagggtctggagaaagcttgtcccagtgatgccttgattttagccccatgagactcatgacttttgctcgtctccagagctgcaagataatcaatttgagtaaagctattatgcatgtgggaattcagtagcgtagcgattgagaataaataacccccaaccccgcaaccaacttagatgagttgtgatgtttgctttggatcttttttgtttttaagaaataaaatatagttaagttctcataagtacccttccctccctagagaaatcagtatcatgatttaataattataattcccatttcaaaaattttcatccatgattaacatataatatgttttgcaggtctttacataaaagacactgcgtggtgtgtatccctcaagcaacttgcatgtttttgcttgaccttgtgaagattttccatgttgatgtagctttattttaacatccatgagcaatttcactcaacagtacagcacgatagattgatctgtcctgtcaatgctggacatttaggttgtttccaatcatgatactcccgattccagcaaacacgtcttcgctattgtttgaaattactataggattctaccttattttttaaaaacctatctcccattttttcgatattagatagttgttttttattttctttaattttttttttcttgaggtggtgtcttgctttgtcacccaggctggagtgcagtggcacaatctcagctcactgcaacctccgcctccagggttcaagcgattctcttgcttcagcttccccagtagctgggattacagttgtacaccaccacgcctggttaatttttgtacttttagtagagacggggtttcactatgttggtcaggctggtctcgaactcctgaccacaagtgatccacccacctcagcctcccaaagtgttgggattacaggcatcagccatcacacctggccaacatttcattttgaaatggcttccaaaaaatctgtggctgtgcagaggtgcccaccaacattctgtctggaatgaaaaaactagaagttagctccttcaggtgagtacagtcttttttttttttttttttttttttttttttttttttttgagacggatctcgctctttcgcccaggccagagtgcagtggcgctatcttggctcactgcaagctccgcctcccgggttcacaccattctcttgcctcagcctccacagtagttgggattacaggcgcccgccaccgcgcccagctaattttttgtatttttagtagagatggggtttcaccgtgttagccaggatggtctcgatctcctgacctcgtgatccacccgcctcggcctcccaaagtgctgggattacaggcgtgagccaccgcgcccggcctcaggtgggtacagtcttattcatgtctgtacttccagcttttgctaccaagtgttcccagtagatgcttagtagatatgtgatattgaatgtgtaactgctaccttgacctaccaccttctcttgatgaggaacctatagatttgttttctttctttttttgtttttgttttgagactgagtggagtttcactcttgtcgccgggctggagtgcagtggcgcaatctcagctcactacaacctctgcctcccaggttcaagcaattctcatgcctcagcctcccaagtagctgggattacaggcatgcgccaccacgcccagctgattttgtatttttagtagggacggcatttcatcattttgatcaggctggtctcgaactcctgacctcaggtgatccacccacctcagcctcccaaagtgcaaaagaaattaatacttttattgagataaaaacattgtataccctataatgtaccccttaatgtatactgttaagtggtttttagtatattcagagttgtaccaacattatcataatcagttttagaatgtttcataatttcccccaaatcctatacattagcagtcacctctactttactttcccccatccctggcaatgacaaatctactttttgcctttacagagtttcctattctggacatttctcacaatacatggctttttgcatttcactttttttttttttttttttttgtgagacggaatctcactctgtcgcccaggctggagtgcagtggcatgatctcggctcactgcaagctctgcctcatgggttcatgccattctcctgcctcagcctcctgagtagctgggactacaggtgcccaccaccacgcctgtctaattttttttgtatttttagtagagatggggttttgctgtgttagccaggatgcatctcacttctttagcctaacataaggttcgttcatattgtagcatattatcaacacttcattcctttttaagactaatattccattgcatggatagaccatattttgtttatccattcatcacttgatggacatttaggtagttctctctttttggttactgttttcattttctttgttctttctttcctttctttcttttctttctttcctttctttccttcctttcctttcctttcctttcctttcttttcttttctccttttcttttcttttcttttcctttcttttcttcttccctccctccctccctccctccctccctcccttccttccttccttccttttctttctttctttactctctacagtctcactgtgtcggtcaggccggagggcagtggtgcgattttggttcactgcatcctctacctcctggattcaagtgattctcgtgcctcagcctcctgagtggctgggattacaggcgtgtaccaccacacctggctaagttttgtatttttaatacagacagggtttcactatgttggccaagctagtcttgaactcctggcctcaagtgatccacctgccttgcctcccagagtgctgggattacaggtatgagccaccgtgcctggactctttttggttattgtgaataatactgcggtggacattcatgtacaagtttttgtgtgaacacatgtttccatttctcttggctctttgcctaagagtggaattctaggttatctgtaactgtttaatcacttaaggaattgccaagactgtttgccaaagcagttgcaccatttactttcccaccagcaatgtatgagggctccaacttccccatgtcctcgccaacacatgttagtatctgtctttttggttatcaccatcctagtggaggtgaagtgttatgtcattgtggttctgatttgcattttcctgattgctcattgctctatcttaaatagttgatgtaataatttccttctaaacattggctttctgtagacagtgtcctattttcaacttttctgggccccagcattgtcttctggcatggggttggtgctgactagggcgtaaatgaatgaggcaactctggatatgttagcttgcagcacatgggcatggacactgattggcaaggatgtgcttcttggcttgagtcaagaatcatacattttaaccatcacttctgctttttttgtggcacaaaaggaccattttttgaagttagtaacctgtcttagttccctcagtagatgtttgtccaaatgttgcggtgaagcatagcacagacttttcatcatttcaaggtttaacgcctcagcccagggagtgtatatttggtgaccgttttcccagagccctggaaatgcttcttcctaactgtccactttgagctcctctgcctcctctttggcaatcagttacctcctaagaggaacctggagaaatgtcattgggaagtgctgctggcaccaggatgagagagtgttcttgaaagcttgggagcagtattgagcatctgccatgtgtcagtattgtgctgggcactacaagctcacatgtatccatgtgatcatgtgtatgggtatttatttgtagtgtctagtcattacaatctgtctgtgagttttgcctggtttactcctaagtacagtgagcttcagtgatttgcccaaggttaccaaagttttcagaggaacaacatcagacacttttccccaatcaccatgtgccagaaaacctttaggttaagaggttaacaagacaagccacagataggggaaaatatttatgaaacaagagctgataaaggacccatatccaaaataggcaactcttaaaactcaacaataaaaggccaggctcggtagctcatgcctgtaatcccagcactttgggaggccaaggtggatggatcacaaggtcaggagatcgagaccatcctgactaacacggtgaaactctgtctctactaaaaatataaaaaattagccgggtgtggtgtcgggtgcctatagtcccagctactcaggaggctgaggcaggagaatggcgttaacccaggaggtggagcttgcagtgagcagagattgcaccactgcacttcagcctgggtaacagagcgagactccatctcagaaaaaaaaaaaaaaaaaacaaaacgcaagaaaacaacaaaaaaaaccaaaaacaaaagctcaacaataagaaaacaacccaattaaaaagtgggcgaaagatctgaacagatgcctcacacccccttcccccaccccactcacaatgctttgccatccatgtctccatcctgcagtagccaaagctggctgcttctggaccactgctgtgcaatggaaatacagtgtgagtcaccaataccagccatgagagtagtgttttgttttgtttttttttttttttgtttttttttttttttgctgttattgttgttttgttttttaaatagagatgggattttgttctgggtgaagtgaatcaaactcctgggctcaagtgatcctcccagctcagcctcctgagtagctgggattacaggtgtgagccactgtacgcagtcatgtgtgtagtttaaagttttctagttgccacattcataaaggtaaaaagaggtgaaactaactttattaataaattttatttaactcagtatatccaaagcattattatttcaacatgtatgcaatataattattaacgagatatttgattctggtttttggtctgtgtcttcaaaatccagtgtgtgttttatacctataacacatcttgattcagacagattcaattctgagtgttcaaaagccacatgtggctagtggctaccatattggatagcacagatctagattatacctcttttgtccttttgcattacctgcttccgtggtccccaagcagcaaaggcattctccatgtggcaggtactatgatcatcatagtggtgctccctgtgtgtgtgatcaggtagctttaatttcccacagagactgaaaatgtggaagtgtgtctaccagctttgccatctgtcctagatttaggtgtgacatctgattgctgggcccgagcatccagtgccagctgtacttctgcagattactgggtaatcacagtagaacctttcttgggggttgcttttgacccaggcagcactgctcagcttgtggccagggagcttcatgaccattgagagtaggagtctgcaccattacatgatcataggatagcctgcagacatgtgattcgtgtcttgtaagttgtaactgagtaaatttttatatatggaaagaaatagaatgctgaaagggggatcatgagggtccaggtgtggggctggggacatggaaggcctcactgagaagctggcatttgagcaaaggcttggaaaagttgaaggagtgggctgtgtagataagtgttttgagggcttcaggaatggccaggacaaagccttcgaggtggggcatgttctggggatagccagccaagcagggtgatgggggcagagttatggggaggaagcaggggtcacatgacccagggctgtggaggcctccatagcactcaagcttttcctccagggagccgggagccatgggagagtttgcagtggatgacggatgactgatatggcccctcgggctgctctggttggctttctcctgagtcgtccattctaccttctcgccaaggcttcctaggtcatgtttcaagtctgttcaatgcatttccttctccaggtggtcagtggagacctcacagcagaggcttatcttgttgaacgtggtgattcatgtggtgatttcacagggtcagctccccatgtcttgtcccagcggtgtcctcctcctacatcaggagagggaggtcagctctgggacccaagaaagggcagggtgccttggtaacccttctgcaggcttgagggattggggcagtgtgcatctctgcgaggagggcactgaggaggatgggcttctcagatcctgggctctgccttctggatctgagatccaagttgcaaaggaagagctggtttcaggctgaagcattttttcagcttcatacaaggcaggaagcccatcaagcccccacatcgtcatcattgtcatcactgtcactaacgccaccataagagctgacatttatgtagtatatgtttatgtacctgttacagctctaagagctttccctgtattattgcttacttaattccacaactgtatgtgttcaatacgcattatttccattttacagatgagaacattgaggcatagcccagggtcactgtattagtctgttctcacggctataaagagctaccaaagactgggtaatataaaaaggaaagaggtttaattgactcacagttcagcatggctggaggggccccaggaagcttacaatcatggtggaaggtgaaggcggggctggcatgtgacatggagaaagcaggagcaagagagagagggagggaggtgccacatacttttcaacagccagatctctcaagaactcactgaatattgcaaggacagcaccaagagatggtgcaaaaccgttaatgagcaattcatccccatgatccagtcaccttccaccagaccccacctccagtactgagggttacaattcaacatgagactgctgcggagacagatatgcaaacaatattaggttgtttctaccttttggctattatgaatagtgctgctgtgaacattcatatgcaggattttgtgtagatgtgttttcctttctcttgggtgtacacctaggagtggaattgctgggccatgcagtaaccattcatttaagcatttgtgactacatttaaccttttgaggcaccaccagcctgttttccaacggggctacactgttttgcatttgccaaggcctgttggctgttttggaggcaaacccctccccttaagttccaaagaagtgaatccccagtgtcctgaggtcagaatgtccagggcacccttttagagagagagggaggagggtcctgagagactgtactggagaggctgtgtggccccaagcccacagcactgagtttgagtctcagctctgccacctaccactgtgcaatctttttattttattttattttattttatttttgagatggagtctccctctgtcgcccaggctggagtgcggtggcatgatctcggctcgctacaacctccgcctcccagattcaagccattctcctgtctcagcctcctgagtagctgggactacaggtgcccgccaccacgcctggctaattttttctatttttagtagagatggggtttcactgtgttagccaggatggtctcgatctcctgaccttgtgatccacctgcctctgcctcccaaagtgctgggattacaggcgtgagccacctcacctggccaccactgtgcaatcttgagcaagctccatagcctctgtgggcctggcctctgtttccccctatgcaaaatggggcttatcagagcatgctggaggggctcccatgagatcaggggagacatgagcttggtgtagtttgtggcctattggacctgcctgatgaaggttgctgcctgtgaggttggtggtgtctaccaggcattgtcctctaaaatataatactcctattctaggggtgaggaaggagtgtgggtgtgtgttctgagtagctcatgagagagtgggaacctgtgctaagccaggcctggtctctctgagcatggtgacttggacttgttgcttttgtggcagggaactgaaactgttgcagacactcttggcctgaccttatcccctcagcacacacctctgcacaccacaagccacttgctggaaacacctgtgactatgcctgagggcttctgctagcctgtggtgcaggataggctgggagtgctggggtgttagtgcctccaggggtggcatggctgggtggggaatcggcagatcaataccccagctccctcaccctcagtcaggacactcctggcttgttctgcactgactcccaggcttccccaatggacttcggctctatttactcacaggaataataagcttgatgacacagcctttatttgctgcgcttccttccctgtccaccaccccattccccttgcagtgattcctgggatagcccccaaataaactccttgtatgtacatccttgcctcagagtctgtttctgggggaacccagatgaagacagagacccacttagaccctgtgtcaggaaacacatggaccagacttgggccaccctgggacttgctgttttctctgttccctgcggtgtgtgagcctgtgtgtgcctatgcatgtgtctttctcctcttgcccctgattggctagccttgtcacttctgtcctgattctagagggagtgtctgatgtcccagttattgctgccctcagcagagtcaggattttttggccggggcggggggtggggtcagaaaccagctcaagcaaaaaaagagaatttactggaacgtgtggctgagatgcatactgtgtagctcacagcatccaagatgcaatgcctttcccatgctctcttcatctttctgccagtctttgtctgccaccatggttctctccttttttttttcttttttttgagatggagcctacctgtgtcaccaggctggagttcagtggcgtgatctcagctcactgcaacctcctcctcctgggttcaagtgattctcctgcctcagcctcctgagtaggtgggactacaggcactcaccaccacgcccagctaattttgtatttttagtagagatggggtttcaccatcttggccaggatggtttctatctcttgattctcgtggcatgcctcagccttccgaagtgctgggattacggtgtgagccaccgtgcccagcccatgcttctctcctatcccagacgactctagtctatagaacacgtaacgtggccatgagcagcctcataagagaccgtttttctctcagcatctatgcttggccttcgttatttgcagcatcagtattggtgaatttgcctttctgctccaacttatttgcaacctgcaaaccagtagttctggcccttctgtggtcattcttggtgatgcagactggtgaaaaatttgggtcacccattcacacatgccctgctgaggtcaaacaagatgacactctgccttcctgttttagctttctttttgcaaacaggtgtcctttctgccgtccacttagtgccttattttctgcaatttctttctttttattttttgctggtgatgttgctctttaaaatggccctgagcaaagtgcatttatttctcattaattcattcttcctgttattgatttattcagtgactatctatggatcatttgctcagggcaaagcactgtattgagttctgatagaaggagacagggtctttaatttcatcgaccttattgtttagtgggagaggcaagcacaacattgatcaaataattttgtacatgactatatttataacgaaaatgaaggtaacttttgcttccctctctaagaggcaccaagggaggttatgcacctgagaagcagcccagggaacagcagcgaaactgatctaacagtggccttcctggccctagtggctgtgctttgtggtctaaggccacatttaacctgtgtaccagagggacatgagtgtgcacttcctggaatgaccctgaggtgttcagtgtgctggggaaggtcatatggcaccacgtatgacagcagtgttggggttgaacaagcctgggcttgcctcctgagtctcccattctgtctgtgtgactccctccttgggtctcagtgtctgcatctgtcaaatgggcacaccggtggtaccttcctcgtgtgtgggtgtaaagactagagatcgggtatgtaaaacctttaggttagtgctcagttatgagcactttggttggcagtatcatcgataagggatggttttgcacgtcggggttcaggactcaaaagggaaggccattcccagtgttagtcacctgagaagatgatggattccctaggctgggaactggtttcaggatgatgtttccgttttcttttttctttttttaggtatttctcctagtgctatccctcctctagtcccccaacccctaacaggccccagtgtgtggtgttcccctccctgtgtgcatgggttctcattgttcaactcgcacttaagagtaagaaaatgtggtgtttggtttcctgttcttgtgttagtttgctgagaatgatggtttccagcttcatccatgtccctgcaaaggacatgagctcatccttttttatggttgcatagtattccatggtgtatatgtgccacattttctttatccagtctatcatcgatgggcatttggattggttccatgtctttgctcttgtgaatagtgccgcaataaacatatgtgtgcatgtgtctttatagtagaatgatttacaatcctttcggtttatacccagtaataggattgctggatcaaatggtatttctggtgctagatcctcgaggaattgcaacgctgtcttccacaatggttgaactgatttacactcctaccaacagtgtaaaagcattcctatttctctacatcctctccagcatctgttgtttcctgacttttttttttttttttttttttttgagacggagtcttgctcttttgcccaggctggactgcagtggcgctatctcagctcactgcaagctccgcctcctgggttcacgccattctcctgtctcagcctcctgagtagctgggactacaggcacctgccaccgcgcctggctaattttttgtatttttagtagagacgaagtttcaccgtgttagccaggatggtcttgatctcctgacctcgtgatccacacgcctcagcctcccacagtgctgagattacaggcgtgagccaccgcacccggcctgttgtttactgactttttaatgatcgtcattctaactggcatgagatggtatctcattgtagttttgatttgcatttctctaatgaccagtgatgatgagcttttttcctacgtttcttggctgcataaatgtcttcttttgagaagtgtctgttcatatcctttgtccactttttgatggggttgttttttcttgtaaatttgtttaagttctttgtagattctggatattagccatttgtcagatggatagattgcaaaatttttcttccattctgtatgttgcctgctcactctgatgatagtttcttttgctgtgcagaagctctttagctgaattagatcccatttgttaattttgccattgcttttggtgttttagtcatgaagtctttgcccatgcctatgtcctgaatggtattgcctaggtttttttctagggttttttatggttttaggtcttatgtttaagtcttttatccatcttgagttaatttttgtataaggtgtaaggaaggggtccagtttcagttttctgcatatggctagctggttttcccaacaccatttattaagtagggaatcctttccccgttgcttgtttttgtcaagtttgtcaaagatcagatggtggtagatgtgtgatgttatttctgaggtctgtgttctgttgcaatggtctgtatatctattttggtaccagtaccatgctgttttgttgaccatagccttgtagtatagtttgaagtcaggtagcatgatgcctgcagcttgttctttctgcttagggttgtcttggttatgtggtctcttttttggttccatatgaaatttaaagtagtttctaattctgtgaagaaagtcaatgatagcttgatgggaatagcattgaatctataaattactttgggcagtatggccattttcaccatattgatgcttcctgtccatgagcatggaatcttttttcatttatttgtgtcctctcttatttccttgagcagttgtttgtagttctctttgaagaggtccttcacatcccttgtaagttgtattcctaggtattttattctcttagtagcaattgtgaatgggagttcactcatgatttagctctgtgtttgtctgtcatggtgtagaaatggttgtgatttttgcacattgattttgtatcctgagactctgctgaaattgcttatcagctgaaggagatttttctataacagtgtaaaaacacaggagcttaaaacaacaattctgtgggtcaggaatttgggcagagctcagtcagtggatttgctgttctgtctcacttggtgttgcctggagtcccttacctgaatatattcattggatggccaggctggaagttcccaggcagctttctgggccaccagtgttcctttgtgcagcgtctctccctgttctgtggctagtttgggcttccttacagcatggtggtctcatagtagctagtcttctctgtgatggcttccaagggacagaaagcagaagcctgaagcttttgctgtgttaaaaggaagtcacaaggccagccctgacacagggaagggaaatagattctacctgttgatgggaagaagtttgtggctatcgtgaatccaccagagatggagaccatggtattcaggggcatctctctgagccttgaccttgggtgtgttgagtgatctagaaggcaggtctggtacttggatattagaaggctgccctccataaggagagaggataaggggctgggaacccaggctggggtctgtgtgttagtgccaaactttggggctaggatataaatgtcttaagatacagcggaggggaatggtaccgggtctgaaggataggctgtctttttgcttgttttctggttatttcactgttctcctcaataggtaataaggtcttctcaggggacctgcctgttttagcagtgcttcaggagctgagacaggggcagagatatagtctggggtcagaatgtttaggagtggaggatctgcgaggtggggtgtagccgggattggattgaaaggtacccatggggactgagtgcagtggctcatgcctgtaatcccagcacttgtggagattgaggcgggcagatcacatgaggtcaggagttcgagaccagcctggccaaaatggtgaaatcccatctctactaaaacaatacgaaaattagccaggcatggtggcatgtgcctgtaatcctagctactcgggaggctgaggcaggagaatcacttgaacccgggaggtggaggttgcagtgaaccaagatcatgccactgcactccagcctgggcaacagtacgagactctgtctcaaaagaaaaaaaaaagacaccctgggggacatgaagcacaggcagaatggagagcaaggacccaaggcttttgtcctgtctcactgttcccttgctgtgtgaccacagggagttaacctctctgaaccttagtttctttgtctctgcagtggggattatgatgatcctctccccatagagttgggataaagattaaatgagccaatacacattaggtttgtagcacagggtttgtctagagtaagtgctgactaaacgtcagctgctggagatggtggcgataagaagttacttttattattatcaggactgcttgttccagtggctgttccagcctgacaaatcttccaaggcaaaaccagagttgctgaagttaacttttaaacatttcctttttttcctgagttatggaaggaatgataattggggaatttaggcttaaaatgaagcacctgtgatatgacgctctggaacgcctcttcatgcagagggtggttatgcgaagggaggaggttttattgcatatggggccttactggacagtgaagggagggggttcccagctctccctggtgggcccaggctagagcatgggtctcccagtcctcaccaaggggtctcagcctcagcaggttggcagccacacaacacagtgagatccttctgtgtagctgagcctctgattcccagaggtgaagatacagtcttagagtgtatcccagggaccctgtctttccagcgggaaactgcaggggctgagagaccaccccctagaggcttcctcatttgcatctttaacactgccatggttgggggctgttttcttcttcagcctgccctgcctgggctctgttgactactcagcctgttgttctgaagttctcctggccctttcagaggccatgggggctcaaaagccactcagaacacaagtccctcttcagctgctgggagtctgagcatgggaaaatcctgcctgattttttccagttcccatgcaggtggtggcttcttcgattctcgcggtcttcttggtggaaacctttgtaggtcttaagtgcgctataattgagcagtcttaaatgaccagacacagtggctcacgcctgtaatcccagcactttgggaggccaaggtgggcggatcacttgaggtcaggagttcgagaccagcccggccaacattgtgaaaccccgttttttactaaaaatacaaaaattagccaggcatggtgacttgcgcctgtaatcctggctactcaggaggctgaggcaagagaattgcttgaacccgggaggtggaggttgcggtgagccgagattgtgccactgcacttcagcctgggtgacagagcatgacttcatctttaaaaaaaaaaaaaaatgtgccttcacggacaggcacgatggcttatgccggtaatcccagcactttgggaggctgaggcaggaggatcacttgaggtcaggagttcgagaccagcctggccaatatggtgaaactctgcctctactaaaaatataaaaattagctgggtgtggcagcacatgcctgtaatcccagctacttgggaggcagaggtgggagaattgcttgaacctgggagatggaagttacagtgagtccaaatcgtgccactacactccagcctgggcaacagagtaaggccctgtctcaaaaaacaaataaattaggcttcagatactgaactatctggcatatcctattttgggaccatgaaaagggtgacctggcaagtctgagaaggagaccttttccctcattataattttttttttttgagacacggtctcattctgttgcccaggttggagtgccatggtgcaatcacagctcaactactgccttgacctcctgggctcaaatgatcctcctccctcagcctcacaagtagctgggactacaggcatgcaccaccatgcccagctaattttaattttttttttttttttttttttttttttttagtagaggtgggatctcactatgttgtctaggctggtcttaaactcctgggctaaagcagtcctcgcatttcagcctcccaaaatgctgggattacaggcattagccacggtgcccagccagaaattatgacttactcccaaggtcctgatgtccagaagcaagaactgaaagtgcggttgcgctgttatcattagtgggaaaacactcaggcacctggggccacatccggttctgcctctttctagctggtctagagtcttctctgagctgggctttttttcctatgcccattgcacagttacccatttattgcccagaaggtgacgggcactggatgcgttagatgctggggaaatagaggcacaaccatcacagtgtccttcttgtgagttttgaaggctggtggggagagacggatggtaaacagggaggtgaagacaaagccctctctttacaagcgaagtcagcacaagggacaggaagagcgcacatgatgggtggtcagaaaaggcctctctgaggagctgatatttaggccgagatccgatgggaagaatcctctaggtggagaaggactatgcatccatcccccatgtataaaatgggaataatattagtacctgtgccgtgaggcagttgtgaaggtaaaatgaattagtgcgtgtgaagcacctatcttccactaaaaacagaaagctgttttagatgttgatattactattattatttttgagaaggagtttcgcttttgttgcgcacgctggagtgcatcgtcttgaggggtgctgcgcaaggcactagggtggttttaaacgccttttgtcagctgtgtttggtgttgctacagcttcagtaaacacaagtgataaaacaagagccctcaaactgcacctggccttccagaagatgacaaagatgtatgtagaacatcagagggtaccttgtgattattttattttatctatttatttttaaaatttcaagtagagatagggtctcactgtgttgcccaggctggtctaaaactcccagactcaagcgacccccatgcccttggcctctcagagagctggggttacaggcataagcccctgcactcggttgtgattctttcacttaacacatttattgataagttattacatgtcaggcccaggccagggtaggcaaaaatgagacaagctccctgtgcttatgaacatgttctcacgttccttactgtttcggggagaagggggttaagtgaacacttggggttgagagcaaagacccaaaggagaagacagattctgggagggaaggggcaagattagagagacctggttgtcatctactctctgttccttcctttcatgtggcctgggctcggtcacttcctctctgtcggctcgtgtcccctgatctgtgaagtgagaattacaacacctactttacagggctctcgtgagtattcagccagctagtgtgttaagctcttactcccgttaggattgcttcggccctctgtgcctcagtttcctcactggtgaggtcctttctgcctgatcaagtctgtggctcagtcagctcctcacttcctgcccctctggaggacatcccattagtctctcattccatcgtgctcttctctttgggagcattgtcatatggtggttatttatatttatgtgggcatttaatgtctctctttctcagactgtcagctctttgaaagggggctgtttgttccattcattgttcctgtgtcatgcatgatgactagcacataccaggtagaccatagatgctgtctgcatgggtgaatgccattcttcctctgcttgcatcttggggatactcatcggctgcacggaaatggagctccgaaggcctgagcttcaggaattatctgcttggtgggggctgtgtttctggaggcttcagtggcctgaacaatagccaggacagagccaactagccgggcataccttttctctgcagcagcaagccttgttggcactgtgggcagcaggaaatggctgaaataacttccatcatgatgccccttgtcatgagtttccatggaaactgagggctgctgagcctgtcactctggcataagggaggagtgtggagggcagcctcatgagaactggtatttaggtagaatatgaatagggggatttgattccttttccataagctagtgtgggctcatggattttttttttttttttttttttttactgtggtggggctctttgaatcacaaaaataaatacagctttttagtgagaacttagggtatttccaacactgtcatcttatttcatccttctaggcccaccatgaggcaggtgtaactccttcaatttgcagaggaagctgaggctcagagaggtccagtgacttgctcaagtctacacagcggggcatggcagagttcagatccacattctggtcggcctgactgtggggttcagtggaggttggcggtgcttgagcatggaagacaaagaccttgttgggtgccgggctgcttctagagatggatgtggtgggtggaggatggtttgtgttctttccagagtcagatggctgggcagagtcaggacatcctgggggtgttggattcccaggtgtggagtgacaacactgcctcatatccattttcagagctcatttctgaggcttcatctggtaccaaccctgtgaggcgagggagctcctgcgaatccccttgtgcagccaggcttggagaagtcaaggatttggcttggggcacccaggaagcctgaggcttagctgggtggacctcctggctcctcgcccactgcttttcaccctgccctgaggtgtgagatcttcccagccacctctggaaggctggactctatcccagctcagttatttatgtatttattattattattattttttgagaccaagcttcgctctttcgcccaggctgtagtgcggtggcgctatctcggctcactgcaacctccgccttctggtttcaagcgaatatcctgcctcagcctcctgagcagctgggattacaggtacccaccaccatgcctggctaatttttgtatttttagcagagatgggggtttcaccatgttggccaggctggtctcgaactcctgaccttgtgatctgcccgcctcagcctcccaaagtgctgggattacagctgtgagccactgtgcctagccctagctcagttttaaaaattacatttagtaggtcttattttccattatcagagaaatgcagattcattctagaacctttggaaaagatagacaaacacaaaagaaaaatatctcccattgactaccctccagggagcactggacccaaactaggatctggttgcttttctgtgaagatgtcctatttcatctttaaggattatgatcttttaggtaatggaagttgtgcttcatattttaagaactttttaaaatgaactttatttcatatttaatttatatacaataaaaggcactcattttaagtacacagtttgatgcattttgacacatgtgtagacatgtgtaaccaccaccctaattgagacacagaacaccttccatcgcaggagagagggttccctcacttccctctgcagtctgcagccccccaccctccccagcatgcacactccctgccccaggccaccccaacctactttgagtcatccaggatttttccttggttttagaatttcataaacatggaatgaaacagtagactgtgttttgcattcgacttcttttgtgtgatgttctcaaggttcacccatgttgttgctagtgtcagtagtttttccttttctgttgctgagcagcattccagtgaccgaatataccactgcctactcccccattctcctcatgggagatcttgggcatatcagttttcccctctgtataatggggaaacattacccaatttttttttttttgagacagagtctcactctattacccaggctggagtgcagtggcgcaatcttggcccactgcagcttccgcctcccaggttcaagcaatcctcccacctcagcctcctgagtagctgggattacaggtgcacaccatcatgcctggctaatttttgtatttttagtagaggcagggtctcatcatgttggctaggctagtctagaactcctgacgtcaaatgatccgcccacctcagcctcctgagtaggtgggattacaggtgcacaccatcatgcctggctaatttttgtgtttttagtagagatgggggcctcatcatgttggctaggctggtctagaactcctgacgtcaaatgatccgcccacctcagcctcctgagtagctgggattacaggtgcacaccatcatgcctggctaatttttgtatttttagtagagacagggtctcatcatgttggctaggctggtctagaactcctgatgtcaaatgatctgcccgcctcggcctcccaaagtgctgggattacaggcgtgcgtgagccgccgtgcctggccacattacccgctttatcagattgttgtggggattcagtgagttaacatgtgagtgattagaataatgcctggcacatagcagatgctaaatatcatagtaataataatggattgttgtctcttgctgtgtaacaaaccaccccaaggcatagtggtgaatactggaggtatttccagtttggggctcttgaataatatgagtgaatgaatgaaataatacaaatgtacatgtgtagttgggcagcctcggtggctgttgccttcctcgagggctcgaatgctgtgtgtcttggtgatcggctgacaggcagccgttgcctcttctaagatgggtggttttccttttgaggtgggtcctgggggctcctggctgctcagtgctggccctacttgttgccttgtgtgctgctctgagccaggcttggtcttgctgggctgaccaacccatttaagcctcaggaagtggcctctgtagaaaaaaatgtataagcagcgggtggtgaacagatcagtggagcgcagagccccaaaatagatctttctccgctaacttgccaagcaactgggggcagtggcaaatgctttgcataacttcctacccaaaagaaaaggttttactgcaaacaacttttggggacccctcccctctcaaataatctcagacagatccaagatgtttttttttttttccagagcagcacaaagagagagccagacaggcctggggttccatcccagatccaccatttgcaggctgtgtgattttgggcaaattccttaacttcgctgagccttctcttttcctgtgttaactagggaagatgagactagactctccagtgtgtatgcaaagcacccttacgctgcagagatgctgcaaatagggagtgtcttttttttcttcctttttcaattttatcctctgtgcttgccctagagcttgttatcaatttctcttagctttgtcaattgtggtggggtgtgggggattgagatttggctttcctgggaagatgttccaaaactgtctttgaaataatactctcctcctctgcagatcagtggacagggtgttgaagggtcggcataggtggtaagcatgattgatggcccccagagatgtccatgtcctgctccccggaacctgtgggtatgtcatgttacttggtaaagaggaccttgcagatgaaattaagtgaagaaggttgagatgggagagtattctgggttacccaggtggatccagtgtgttcacagggtccttttaagaaaaaggcggggctgggggcagtggctcatgcctgtaatcccagcactttgggaggccgaggcgggtggatcacctgaggtcagcagttcgagaccagcctggccaatatggcgaaaccccgtctccactaaaagtgcaaaaattaactgggcatggtggcgtgtacctgtaatcccagctactcagaaggctgaggcaggagaatcgcttgaacccgggaggtgaaggttgtagtgagtgaaccgagttcatgccgctgcactccagcctgggagacaagagcgagactccatctcaaaaaaaaaaaaaaaaaaaagaaaaaggcaggagatcagagtgagtagaagacaatggcaagatgatggcaacagaggttggaatgatgtgcttcaaaggcagaggaagaggccacacggccacgattgcaggcggccactgcaaggtgaaaatggccaggaagcaggttttccctcggagcctccagaaggagccagtgctgccgacaccttggttttagcccagtgagactggttttgacctaggagctgaaagctgataaatgtgtgttgctttaagccactgagtttgcagtaattggtgcagcagccgtagggcacttataaagcaggcgaggcctatgttggctgtggtttcacaggaaagtggcctcttggatgatggcgccttatggtcatttttatgtttcttcccttctgatctggatggattgttttcagttcagcctaggggaggtctggcttccccggggctttacctcgagactggatctctgcagtcaggcctctggtgagcccctgtggccggggcagctgcagcagagaggcttcctctctcgacagaaacgcagaagtgagctgcttgctcgcagaggccaggcttcctgtctggccagtccctgaaatgctgctccccacccctcgccccatgagagtccaggtgaagattgagtgggggtaggggctgcactgtctgatctctgaagtgagccccttcctgtctagcttggatttgtgttgaaggctttaagatgactgttttcttgtttatttacttttaagagacaggatctggctctgtcgcccaggctggagggcagtagtgtgatcatagctcactgtagcctcaaactcctgggctcaagcgatcttcccgcctcagtctctcaagtagctgagactacagatgtgcaccaccatgcccagctaattttttttttttttccctgtagagacagggtctctctatgttgcccaggctggccttgaattcctggcctcaagcaatcccctgacctcggtgtcccaaagtgctgggattccaggcatgaaccactgcacccagacaattcttttcttttcttttttttccttccttcttttcttttcttttttcttccttcttttctttcctcccttccttcctttccttccatcctttcttccttccttcctcccttcctcctttccctttccctttccttccttccttcttttccttctttttctgtttctttttctttttcctttcctttcctttcctttcctttcctttcctttcctttcctgtcctgtcctgtcctgtcctgtcctgtcctgtcctgtcctgtcctttcctttctttccctccttccctccctccctccctctctttctctctttctttctttcatggagtttcactcttgtcacccaggctggagtgcaatggcgtgatctcagctcaccgcaacctccacctcccggcttcaagcaattctcctccctcagcctcccaagtaactaggattataggcatgcgtcaccacacctggctaatttgtgtatttttagtagagacaaggtttcaccacgttggccaggctggtcttgaactcctgatcttaagtaatccacccacctcaacctcccaaagtgctgggattacaagcgtgagccactgcacatggccccagccacttattttcttgtgatttgtcagcaaacagcctctggggttgtgactgctggaaagcacctccagcttttgtggagccaggtgtggctggcacttttcgttgggatcatgtttggatctccctcaggccttctcaccatgttcctcgtgtgccacactggtgagataacggggtgtgggagagactgggcattcagattcagcggttataattaaagggcaacactgaggccaggatggctgggatcctctcgtagctgccatgtgacctctggcctttttgtccttccccatgatgtcacctttcattggatggtgactccctgcacatacccccaaaggtgtccatgtcctaatctttggaacctgtggatatgttacattatgtggcaaaggagatttttgcatgtgtgattaagggaaagatcttgagatggggagattctcctgcatgacccaggtaggcccaatgtaattacaaggatctttaaaagaggaaggtaggaggtcacagtcagggagagagagcaggattctggctttgaaggtggaggaaggggccacaagccaagaaatgcaggtggcctctagagctgggaaaggcaatgggtggattcccccttggagcctccagaaggaacacagccctgctgactccttggtcttagcccagcgagacccgttttggaaatcagacctgcataattgcaagatggtaaatttgtgttgttgtaagccactaggtttgtggggccatcctggcctcagtgatgcttatttgggagtgtgtttttttcctattactgctctaatcttttaaattagatctgaagagatgctctaatttttttttttttttttttttttgagacagagtctcactctgtcacccaggctggagtgcaatggcatgatcacagctcactgcaacctctgtctcctggattcaagccattctcttgcttcagcttcccaagtagctgggactacaggcatggcatgcgccagcacacctggctagttttttgtatttttagtagagacagggtttcaccatgttggccaggctggtctccaactcctgacctcaggtgttccacctgcctcggtctcccaaagtgctgggattataggcgtgagccaccgcgcccagcccgagatgctctaatcttttagagcagtaatagtaggttggtgcaaatgtaattgcagtttaattgtaactttaatggcaaaaattgtgacaacttttgcactcatctaataggaaacacactcccacgtaaccatctcctgagatccctttccttgacccattcggtaaatatttactgagcccctccacatgctggagactctgcttgtcaccagattgaccaaagcaaggtcttgtccttcaggggttcaagtcttaggaagacagagacaagatgacaaggctaagattgtcacatagggtgttaggtggatcgtagagaaagaagacatagaaatcagatggcattggaccagagaaattttctcagatgtcagtgaaaggagctttgaacttggagcgagctctggaaatgttgtctggtcgcactgggtatctagtaaatatttcaaactcaacgtgtccaaaatggaatttgtcaccaaaacaacggagatctctgcctttaaaacctattcctccagttttccccattgtggtaagagataccaccatccagccaggtccccatgccagaaagctagagtcctcctcggcccctttgccaccttcatttctggcatcatgtccacctcctggttcttggggttcatcactgtttggagatgtgcttccctctgccacggcaaggctccaggatcctaggctcagagatgggggaaccgagaaaagcatcaagtatgatctgtgtcctcacctaggtgcagtaggaggtcagtgtaggggtccatgggcaggttccctgggctccagtttcagctctgcacttaccagtgtgaccttgaggtcaaagtgctcgacctcgtgtgcctcagtctcctcactgataaaatcgcaataatagtaggacctatctcacagcagtgttttagaattcaatgtaacaagcacttagaataacacatgttcagtcagtgatagtggtggttgttggaggaagcttctctacaatactcagtgcttcaaatggtgatagcagcagccactcattaaccacgtcctctcagtggtcttattaacctctgtccttggcgctttaaaaatcctcctcatgctttttgacgagtctacccattttatagatggggaaactgagtttcataaagtagcaagaaccttcccaaagccacttagctggaacagctttaccgtgattttctagtatgactctcaaggctgccggagacaattttgagtaattgctgggtttttaaaaagttcttcttctgtatccatttgaggtcttggtttatccctgctggagatccgcagaaccagcctcctgcctcctgtggatccgatgagatgactgaagataggacacttgatcctggacttgtttctacttccagcctccctgttcccctagggaatttcctcatgttttgcagattcctaagccccatgattgtgctgtggcctagggctgcatgtccttgttgaccttgcgctgaaataagactcaggggatgcccctcaacgggatgtgtggtaaggtgcatggttaatctcatacattatagaggattgctgggtttttttttttttggggacagggtctcactctgccactgaggctggagtgcagtggtgccactatcgctcactgcagcctcagcttcccaggatcaagtgatcttatctcagtctcccaagtacctgggaccacaggtgtatgctcccatgcgcagctattttttgtattttttttttggtagagctggggttttgccatgtttcccaggctgatctcgaactcctaggctcaaggagttcacctgtcttggcttcccaaagggctgggattacaggcatgagtcactgtacccggcctgcatttatttctttaaaatcctacttcctctgtttcagatgagggatcagaaacataaatacctgcaggcagctggataggtgacctaaataagagaagcaggttgtatctaggggacaaatgacaataaacacaggctgcacactgggaaagttctaagggtggtgggaaccgtggttaacggggagtcagtgcatgtgtgcctggtgtaaagtggacagatcctacgtcatgctgcaggctcagggtccacagatctgcagttggaaatgtaggttgttactgtgaaatctcctcatttaaaaaaaagcgttgacgccgccaggcacggtggttcatgcctgtaatcccagcactttgggaggccaaggtgggtggatcacctgaggtcgggagttcaagtccaacctgatcaacatggagaaaccccgtctctactaaaaatacaaaagtagccaggcatggtggcggatgcctgtaatcccagctctttgagaggctgaggaaggagaattgcttgcacctgggaggcggagcttgcactgagccgagatcatgccattgcactccagcctgcgcaacaagagcaaaactccgtctcaaaaaaaaaaaaaaaaaaaaaagttgactcattgaaacacacaaataagcaaaatgatcttcacctgacaaaacactcctgtaccctgatgcagttcccaggccaacaacttgtgaagtctgttccagactgttgagaaatgtcattttttttttttttttttttttttttttgagacagaatcttgctctgtcacccaggctggaatgcagtggtgtgatctcggctcactgcaagctccgcctcccaagtacacgccattctcctgcctcagcctcctgggactacaggtgcctgccaccacgcccggctaatttttttgtatttttagtagagactgggtttcaccatgttagccaggatggtctcgatctcctgacctcgtgatccacccatctcggcctcccaaagtggtgggattacaggcgtgagccaccgcacccggccgagaagcgtcatttttattctgtgctgtggtgtggtgcctcttcctttgcttttatgagctgcagttttgatcagcgagtccttgcgggtcagcagagggtcttgagaaaaggttgcttttacaaccttaagcaagttataaaagtcgtctgagactcagtttcctcatatagaagccagccgtcacagcctcagccttccgaagctgctgtgatgattgaacaatgtggcattttcctgagtgcctggtgaagtcgggtacatagaaggtttcaacaaatgtgaatttatttccccttaacttgcattcctttttcttttctgaatgccgaggtgggtggatcatgagttcaggagataagaggctgtatcttaccaactgcattctgattttacaggagatcacagaatgaatttcctgtgtgggccattctctcaaacattgctagtctcaggaatagtcagaaaagcacaggacctggcttttaatgatgacaaggactgccccctctgccctgtcttttttgtatctgtgattttcattcattaatggggtagttagtagtttttattttattttattttttttgagacggagtctggctctgtcacccaggctggagtgcagtggcacgatctcggctcactgcaacctctgtcttccgggttcaagcgattctcctgcctcagcctcctgagtagctgggattacatgcacacaccaacgtgcccggctaatttttgtatttttagtagagatgggatttcaccctgttggtcaggctggccttgaactcctgacttcaggtgatctgcccgcctcggcctcccaaagtgctgggattacaggcgtgagccaccgtgcctagccagtttcaccatgttgaccaggctagtctcgaactcctaagctcaggtgatccaccctccttggcctcccgaagtgttgggattacaggtgtgagccaccacacccggcccatttctctgttttatattgccatgatacctttgccaaaagtgagaaattaacattaccacatcgctatcaaagttccagaatttatttggactttaacagtttctcctcgtatgttctccttctgttccaggattcatccaggacaccacattgcacctagtttttgtttatttccatcgatatgtagaggtgtttctttcttttgaattgctgtagagcattccattggtgacaagagccattttgtccactctctcctgctgggcatttgtgctgagtccctttctcctttgaaattgcagagggtgctgtggtagctgtggatggggaaggaacctctgagtgggggggcgtgtgtatttccagcctcagtagtgagtgccaaatcgctctctagggggcttattctacctctcggtggcatccccactaggtgccaggcactttcctgctgtggacccatgaacgggcagtgctgtcttgccttcaaggagtggagagattaaatatataatagtggccgggtgcagtggctcatgcctataatctcagcactttgggaggctgaggcagggggatcacttgagcccagggatttgagaatagcctgggtaacatgatgaaaccctgtctctacaaaaagtacaaaaattagccaggcatgttggcacgcatctgtggtcccagctacttaggagtctgaggtgggaagatcacctaagcccaggaggttgaggctgtagtgagctgtgatcatgccactcactccagcagtgtcttgtctttttcttcttcttttttcttgagacagagtcttgctctgtggcccaggctggagggcagtggtgctacttttggctcactgcaacctccacttcttgggttcaagcgtttcttgtgcctcagccttccaagtagctgggattataggcgcatgccaccaccactggctaatttttgtatttttattagagacaggatttcaccacgttggccatgctggtcttggaactcctgacctcaagtgatccataggcctcagcctcccaaagtgctgggattacaggcataagcccccatgcctggtaagactgtgtcttaaaaaacaacaacaaaaaaatgtgtggggtgtgtgtgtgtgtgtgtgtatatatatatatacacacatatattttatatatgtatatatatgaatgaaatggcaaaatcatctgccaagggctgcagctgactccagaggaccctggaggagactgacagacacagtgtgtgatagtggagggggatgggaagggtgaggggggcatcgggcttctggatgactgagggtatatgcaagtgcagagacagcgtgactagaatgtccaggcaggagaggggagatggacaggcactgcgggtcatgagggtttcagagagcatacgcagtgtgtcccagctggtgacaaccttgctcttcctacaaccaaccatacacatttccatcttggggcctttgcatttactatttgctctgcctgaaatattctatctcagacatcagcccagatgtcaccacctctggggaggcctccctgataacaccttctatgagagcccctccctcctggtcacacaccatgctttgctcttctttggtttagtttttgtagcacttgtgattgccaagtgtaataaatattgacttgtctctgtctcctcctattagaatgtaattcttcgaggccaggaatttggtctgttttattcatagctgtatccccagctcccagaacagtgcctggcacgctggcttttacctactctttgttgacctaatggctgaatgaacggacgtgaccatcatcgtgagaatctgtggataatagcagcaaacatttaaacacaggctgtgtgccaggcactgcactaagcacttggccatgaacttggtctccttaaatcctcatgtcaatgccacgaaactggccctctctatttgtctcagttttacacctggggacatggtggggttagtatttgaacctcatccaaccccatactccagttgggacccctggctgggtctctgaccagtgctgggaaagagggaggcaggtagatttcagccccaagctgtggagtccagcaggcatttgtaccccgagtgggactcagatccttgtgttagggggaacttaggccagaagtgcctgggctagagggtaatggggaccccaggaggctccccgctcttgccccaatcctgccttgtctgaaagggaaggaaggctcttaccttctagctgtctgcaacaggaactgccgggaggccacgctagccatcccccaactttggtttgcaaaactctgagcctggtggggaaatgaagggctggcttgctaaccacaaatgaagactcatttgcacaggcaaagcgggggcaggggtgactcctcttgccctagcggaagggactgacttctgcaggctgctgtcttgctggagccagtcatgccccaccattgagcctgggcactcggacacagttaccagcagtgggctttgtcgtcctccggcctcagtcttctcctttgataaatggagggggggaatagtgatattgtggcgattctgtggcactcaaatgaggaaatgcacataaagcctttgctcagtgcctgactcatggtgaatacttggggggatattcaccatcattgttaacagtggtagtggtcagaggtggcagtcaccatcagagcctctctcctgggctccgctccacatggcagccacattttaggaataatcctcagattaagcaaaagaggttaagtgaatattccctaatgcatgctcttcttttcctttttgagtagaatctgtccccaccctgcctttttttgagacacgatctcactctatcacccaggtgggagcgcagtggcatgatcacggctcactgcaacctctgtctcctgggttcaagctatcttcccacctcagcctcccaggtagctgggactactgatgtgcactaccatgcccagctaatttgtgtgtgtgtgtgtatgtattttttgtggagatgggattttgccgtgttgcccaggctggtcttaaactgcagagctgaagccattctcctgcctcagcctcccttagtgctgggattacaggcatgagccattgcgcccaggcagaatctaccattttaattacacttctgtgagtggtatgatatccagttgactgcgtgaggatcagatcccattcttgcaaagctagagaatgaggcagaggcctgccatccttgcagctagtgggagaccctgtgggtgacccattagccataagagagcaggctaagtgcccagataggaaggtgtcagcgtgtgaggcccaggcagccagtggtcagccgatacttgaaggcctcctgtgtgcccagcttgctgctggggccatgacagtaactgagggaaacaagtcacgcttgtgagatgtgatgaggacctggaaagggaagtccagaagcggaaggcaacctctcagagagggggtgtcttgtggggacttacagccaaggtgagggtgctttcctgctggcacccacctcgcagaacccattccttccctgagtctggtctgtgagaagagcccacagcatgaggataccacgtttggggttcagcaaccccagaatgaaaatcaccctttaaagaaggagtgctttacctttctgtgggggccacagcctggttgtgtgttagagtcactgggctctggagaagcttctggaggactggggccttctttcgcaatctgtccacacccccagggtcctttttcctggactgtggctccggtcggtacacgggtcctgagccagtattctggcccggggtggccgttccctgtgggtgaggaggaggcacctggaagcccctggcctctcctgttaatcactgacaaggtaaaaggatactcctgcctgtttttttttttttcaatttcaaaatttaaaaaaatcttttttttttttgagtcaggatttcactctgtcacccaggctggagtgcggtggtgtgatcacagctcactgtaccttccacctcctaggatcaagaaatgctcctacctcatcctcctgagtagctgggaccacaggcatgcaccactactcctggctaattattatatatatttttttgtagaggtgggaacttacagccaaggtgagggtgttgcctaggctggtctcggaattcctgggctcgagctgtcctcctgccttggcctcccaaagtggtggggttacaagcatgagccacggcgcccggcctcctgtgtgtcttgcctaacgattgcctttggcgatgggagtgctgaatgcttctggcatctctctgtctgcagaggcttacctgacttcaaaggaagcattcatctttagccagaagctagcaggttcaccccaaggttttctgagaggtcattcagggagcagctgctggaacgtgggaatggggacaggaggtaactggacttaccttgtctccgggccttccactgtgggccacccgcacagactaccctggtgtctttggcatcaaaacccagccaggtggccttgaatgggtgacttcatcttcctgggctgtctctggaaaatggggctttcttcccaagattggtgggaggattaaagagatgttgaggtcaactctgacacctattaaatgttcagtaagggggacctggtttgttctctgtcccagtaggtgtttctgccctgaacttgacctcggagggctcggtgttctgctggctgctggcagaattgtgagggcggtctgtgtgagagtcttagcccaggagccggcgcgggtggtgttggagaactctgggcctgcagctagactggcaggactcagaccccagcttgcccaacctgcctgagcctcagtttccccttctgcaaaatggagttgatgataatggtagttacttagggctttgggagagaccgctgagatgatggacagagagcactcgtcacgtggttgatagaccctggatctgcagagctgctgctgctgctgctgctgttgggagtttcagagctggggctccttgagggatgttcctgagaggaagattctggtaggacccacctgggacagggtgagatctgagcagggtggggaggagaacccactggaccaaggcatggctgccctttacaagggctcccaggacgaggacaatctcctttaacaaaacctcctgccagtccccagagcttcttggccatgagctgaggagtttttatttgttcctttggtcttttatggctaactctggattcctcttgggtggatggggaggcagccttggtccattgtagaactgggtactactgcaaaagtgccaagtccttgctgtaatctgctctctggagaacagaccctgtgggcaggggaaaggcccattgcccacctcctggtgtcatgaacactgtttttctcagtgggaggaggtggaggtacccaaagaggaggaagtggccttccaggtgccacttacttggtttggtgtcagctctgttattgattcactgtgtgaccttggacaagctccttgtctgctttgagccttagaattttatgtctgcaaaatgggtataataatgactcctctgtcgtagggtggctggcacgaaatgggataatttaggtgaagcagttaatatactaccttacgtacagctaacacttagtaagtagctgttataataataatgaagatggccgggtgtggtggctcacacctgtaatcccagcactttgggaggccaaagcgggcagatcacctgaggtcaggagtttgaaagcagcctggccaacatggcgaaaccccatctctaccaaaaatacaaaaattcgccgggtgtggtgacactacttgggaggctgaggtatgagaatcgcttaaacctgggaggtggaggttgctgtgagctgagattgtgccattgctctctagcctgggcgacagagcaagactcggtctcaaatataataataataataatcataataataatgataataattgaagataataggaaaaccatgttattacctatattagtgtcctgtggttgccataacacaagtgccacaaaatgagggacttaaaacagaaatgtacttattcccttgcagtgtggagcttagaagtctgaaatcaaggtgttggtagggcagtgctcccgctggaggctctaggggaggatccttcctctcctcttcctggcctctggtagctgctggtgaccctgggtgtcccttggctggtggatattggcactcccatctctccctctgagtgtgtctctgtccaaatttccctcttacaaggacagtagtcttgggttaggacccaccctaatccagcatgagctcatcttgactacatctgcaaagaccctatttccaaagaaggccacattcacacataccagggactggacttctatgtatgtttttgggggatgcagttcaacccccaacattacccgtttatactttctttccagggccaccaaggacaagaccagagtcattttcatcctgaattggtgtcaactagtgttttcataccctagagactatccaaatgacacagctgacccaatccctgcatttctcagagggggaaactgaggcccagggaggtaaaatgactctcccaaggtcacacagtaaggtagtggcagtgggactggatcgtggatctcctggtgccctgtattggcccacgtgtcagccatggactcgtattcccactggtggagccaagaggtttttgctgtctgcaggggagagcactttggatcttggcttctcgtttcatccttcccttggtagtggttaagagtgcaagctttgggccgggcaaggtgactcatgcctgtaattccagcactttgggagggtgaggtgggtggatcacctgaggtgaggagtttgagaccagcctggttaacatggtgaaacgccatctccaacaaaaatacaaaagttagccgggcatgatggcacactcctttggtcccagctccttaggagactgaggcaggagaatcgcttgaactcaggaggctgaggtgcagtgagctgagattgtgccactgcactccaacctcagcaacagagcaacactatgtctcaaaaacgagtgcaaactttggagcctggccattcaggttcaagttctggctcaaccattgtgaccttgaatgagtcagtgactctctctgcttcagcctccccacctgtggaaggaagacagtcatctcagccttacatgagtgcacaggtgtcaggacccctgctgtgcacacgggcatgtactcagtgtttctgtgcatgtggtttcccttccctttcctcctgtttggttttctctgaagccgaaaggtccttagtaggaagttgaggaccagcgttctccatgggaagactcaacatcagttacaactctagaatttattccaggccatccaagttaaggtagttgtctgtattttgagaacctttctcttgctgtaaaaagcaaacaaaaacaaaaaaagacaaactagcaaactcaaagaacgagaatacatatacatgcagtgctgcttcagatggaagtcagaaaagtgtgtgatcaaatgaaaggctgttgttgaaagggaagtctgcatttactcttctgccagttctcagactacctcaactccttgctgacattcctaggaattgtggtcccagctggcttctatagctgtgtgacctttgccttttccaaacgagtgggcaccctgcaggccacttcctctgggtttcagtgcccagcttatcaggaggctgcatgaacatctatttctagctgggcgggaaataggacgggtcctggcagaaggcggagcccagaggtggctggtagaatcccctgggaggagtaagggatgctctccgcagggacccccgtgtcgtgggtgccatggcaaagcgttaacaacaggcagtgcctagggagcctgaaccaaggttgggagtgtggtttccttctcagttccctttccgtcttcctgattatgacaagaacatctgtttggtaccaacatgtgttttttttttttttttttctccttgatgctgtgcatttttttccattggaatttttgttgagataattgaagaatcacataaagatgtaagaaatgatacagagagatctcatgtgaacgttacccaattatccccaatggtaatatcttgcaaacctgtagtgcagtatcacagccaggatattaacattcacaacattcatagaacccactaccagtcttattcagattttcccccattttccttgtacttgtgtgtatttagttatgtacaatttggtcacatgcatagcatcctatatctgccatcatagtcaagagactaaagcaatgtaatgatttcttacaccaattccatttccaaaattttaacatgtctgtctttgaaagatactaattttcttttttttttgaggcggagtctggctctgttgcccaggctagagtgcactggcttgatcttggctcactgcaacctctgcctcctgggttcaagtgattctcttgcctcaacctcccagcttcccaagcacctgggactgtaggcacctgccaccatgcctggctaatgtttatatttttagtagagatggggtttcaccatgtttcccaggcaggttttgagctcctggcctcatgtgatctgcctgccttggcctcccaaagtgctgggattacaggcatgagccgccgttgccagcctgaaagatatgaaatgtctttattaaaatataacttgcagacataaaaaagaatgagttcatgtcctttgcagggacatggatgaagctggaagccatcattctcagcaaactaacacaggaacagaaaaccaaacgccgcatgttctcactcatcagtgggagttgaacaatgagaacacatggacagagggaggggaacatcacacaccagggcctgtcagggggtgggggcaaggggagggagagcgttaggacaaatacctaatgcctgcagggtttaaaacctagatgatgggttgataggtgcagcaagccaccatggcacaggtatgcctatgtaacaaacctgcacgttccgcacatgtatcccagaacttaaagtaaaattaaatatatatatatatatatatatatatatatgtaaataacatagatgtggtaaaatgcacacatggtgcatgtaaggctcaaggctttaagcatgggtccacctctgtggccattcctcgggtcccggtgacccagtcctctctttaggtgacaccactctgaccccatcagtgagtcttgcatggctaattggctttgtgcctctcttaaaggcttctcatttccctttatgactcacagaaccaagccgagggttttgcttccagcagacaactatttctaggtagaatttaatcatattgtcacgtttccactgattttattattttgcagttcctattgtatatggtgagtgttactggttttctttttgccaaaaacataaaatcactcttaacatacatcagttcaggtgaaaacggtgagttgatttaaagaaaactatcacataaatagtatcagcagtaggcagatacaacaaaccttataaggttgataaacaaatgtttgcagtttgagaaataatgtcatatggctccaaaccaccccccaaaactggtcaatccatgtgtgaggaaaaaaaaaaatctctatatagtctttgtataatgagagttttctgtgtaattttgatacacagtactggtttaaagaaaagcagaattagcctattaaaatattaataggctgtatataaagtaatgagcccttcctttattgccttaataatttttgttatatttgcataccatgagtactattttatatctaatacttattttaatattgattcactatttttaaacttaattttatatagaaaagaaacttgatttcatagtttagaggtgccaggtatgtattttttcaatatattttaaaatatactacagttaagacataacaaagggtgggcaccatttaaatttaattaccagcaggagggtgaaaaacaccaagtttaaatggcaccaaaatgatgaacatttaggctgggcatggtggctcatgcctgtaatcccaacacttggggaaaccaaaatgggaggatcacttgaggccagggatttgagaccagcctaggcaacatagtgagaccttgtctctactaaaaagagaaaacttaggtaggtgtgatggtgcatgcctgtagtcccagtcacctggctttgggaggctgaggcaggagggtcccttgagcctacgagttcaaggatgcagtgagctgtgattgtgccactgcactccagcctgggtgacagggcatgaccttgtctccaaaaaaacttaaagaattatttgatggcccatgctgggggtgttagtggtgagcacataaagctcctcattttctcattgtctcctgagtttggaaatgattgagaaatgaaacatcggcaatcaacgaagggcgatgagatggctgcctggagagcatgcttagaattgagccctgacagctggcccctgagctgcccaccctgtcatggcctgggtggatgcccataggtgtctcagagcagcagtcccagacttttttggcaccaggggccggttttgtggaagataacttttccatgggccagattggcctggggggatagtgtgaggatgattcaagggcattacattgattgtgtacttcatttatattatgattacattgtaatatataatgaaataattatacaactcaccgtaatatagaatcagtgggagacctgagcttgttttcctgcaactagacagttctatctgggagtgatgggagacagtgacagatcatcaggcattagattctcataaagagtgtacaacctgggtccctcacatgtgcagttctcaataaggtttgtgctgccatgagaatctaacgccgctgatgatctgacaggaggtggagctcaggcagtaatgttcgctagacccctgctcacctcctgctgtgcggctcgattcctaacgggccacagacaggtgccagttcatggcctggggattggggacccctgtcttggaggcagctcccttccgagtggcaaggaacagggcagggcacgtggtcccttgggggtggatccagctagaacaagatgaagaggctgagtatcctcagttcctttttccagggagtggtcccttcctcccttggggatggggagtcccagaggggagagaagcaccagtttccccagtatcacttaaaactcttatctattgaatagttctgcatgaatatgaagcattagaatcacagacctaattatttgagcataatgatctgggaagaatctcttcacatggaagcaggacactgattttcgcctctgctgtcagcgcagtggcaacaactctgttgtttattatctttttaacaaagaagataagggcaggcccaccccctatctgcaggccaaaaagtaaactttatttatttatttatttatttatttatttatttatttatttatttattgagatagagtctcactgagtcgcctaggctggagtgcagtggcatgatcttggctcacttcaacctccgtctcctgggctcaagccgttcttctcagcctcctgagtagctgggattacaggcacccaggcgcttactaccatgcccagctaatttttgtatttttagtagagacagcatttcactatgttggccaggctggtttcaaactcctgacctcaagtgatctgcccacttcggcctcccaaggtgctgggattacaggcatgaaccactgcgcccggctgtaaactttactttttgcaaagttttttttcagatatatctctatagggtgtatgttctttttccatttcatagatgagaaaatagacagtaagccagaatagaggcttcttcatacagccaggagagaaagagctggatttaactcatgcctgctagatccttctagagctgggctctttctgctctaccgtgtgtgcctcggaagccccttttgtcattacatgttcttctgctgtgtatctcacctattcccccagctgccatgtcagacgctgctacatgtgtgaagtaacctaacacctttggtttttcttaaagcagggtccttggctgagatcagtaagcaacgctggggctttttacttaaagtgaaaccaccagcagctgggaagctggtgttgcaaggtggtacagaaaaccattcagcctagtagctaaactcaccttggtggagccctcctggggccacgtgatttttatttcatgttatttcatttggtttgcatgacaactcaatgataagcatcactgcttgtacagcggaggaaacagcaaagagaagggatgcaacgtgcctggttcctgtgcacccctggggagcataagccaggatttgaaccaaggtctttgtactccagaactccctacaaagggaggctttctcctcttcttcccaggtgagctccagtctgcagaactcagccaggatgcatgtgctcagagaagcctttcttccccttgctggggaggagccccagtgtggactctgttgcactcctgatgtggatggagatgtggatattcacatatcatatgccggcctggacagggcctgtcctccctcccagactcggagccgtctgagggcaggactgtgtctgtctctgcagtgtggcatccctagcgctcagcgtggggttctgtgactgcctggttgactgaataactgaaagtcggaaaagaggttggggtatgtgtgggaaggtgcccaagccttctgtctgtctgtttgctcgcttgaatatgtcttgagcttccagagagaaatttttgttaagctcattgtcaggtgtggtgccccttgaggtcatgtatgggaattggggaaaaagccatgttcctggtgtcaggggtgggaggacgttccgtgggtgcagggagcctgagagagacagagaatcagtagcgggaggaggaaggaaatgggagcttgaagaacagggtcatggcccggccagcaaaggggtcggtggtgtaaagcggggagtgagaggaagctatgagacgtacggaggggccaaaagtccgcaaggctgtgccagaaggtgatgggtaggcagggagggctgagggagggtggctggagtggggtgccggcctttgaggctgactctaggagactcagtgtgtgggggtttgtttgcagggggtgggagtggagggatgggtggtgggggtggggtggacctgggaagacccgaggtgatgctgggaagggggtggggttgtgcaaagatgaagcctcatttctgtggctgggttatctcactttcttcaagcaggaaactcggccactgagccccaccatgcaagagtgcatggcctgaggtctgctgaccacagcctactttgagaataaagtgttgtttcagtcactatgagcccttggcaaaaatttgaacccatgcagacaaagccctccttgaccatcatttgcccatctccttctcactagtagtgcctgttgtcagcaagttggtggaaatcttttggtaccctttctcacacctttacactcatacgtgcacacttacaaataggcacattccttcttagctgaatccagtacattcctgaaaacacactggagaggaacatttttggattgcaatatattacatcatattacacagagacaagcgctgatgcattaccaactgattgaaacaccccagccaatttccttagtatcacttaacaaccttaagtacctaaaatcagcctaccaatatttttcgcgtgaatacaaagcatctacagcaacaaatgcccaatttttgggtgctttgatgaacccattgctaagcatgtttgcaaaaagtacataggatactatacagtaatgtttctgaattaggatattcttctatcctccaactaccttgtactgtaatggaaaaaacaatgaaatgatctgcttaaaatactaaagattcatttaaattggaccctggttggtagtttgcttgtcagaagcaaatgctgggatgaaagaagaactcaatagaatgggcaggatgccgggtttgatgtgccgttggttgtgtgtctaactgcttctcttccattgcagacagacacgcctttcctttccttttctgtttctgtttccttttcctttttccttttcgtttttcttttgttttctttttctttctttctttttttttttgagaaggcgtcttgctctgtggcccaggctggagtgcagtggtgtgacgtcggctcactacaagctctgcctcccgggtttatgccattctcctgcctcagcctcccgagtagctgggactacaggtgcccgccaccacacccggctgatttttttttttttttttttttttggtatttttagtagagacgaggtttcacgtgttagccaggatggtctctatctcctgacctcgtgatccacccgcctcggcctcccaaagtgctgggattacaggcgtgagccaccgcgcccgggcaccttttcatttttcttttcctttcttttctttcttctttcggatggagtttcactcttgttgcccaggccggagtgcagtggtgtgatcttggctcactgcaacctctgcacccccacaatgggttcaagtgattctcctgcctcagacttcctagtaactgcgattacaggtgcatgcccccatgcccggctaatttttgtatttttggtagagacagggttttgccatggtggccaggctggtctcaaactcccaacttcaagtgatctgcttgcctaggcctcccaaatcgctgggattaccggcgtgagccactgtgcctggcccacaccttcactgttttcattggcacctaggtgctcgtgaacctcgtacagcaggtctatgatctggattgtgcattttgcataaaaaaagagttaataagttatagtagacattcagatagtgagaatttgcatagtgatggacacttgtatataatatgtacatgtacacatggccatgtatgtgtgtacacacatggatgcatacatctagtctcctatttacacaggtcatcgaggagtttttgtcatgtcggtacataaggatctgcctccttaatgttcacagcaaataaattgagacaccatgttctttctttttttctgagacagggtcttgctctcttgccaggctggtgtgcagagttgtgattacagctcattgcagcctcaaactcctgagctcaagcaattctcctccctcaacttcttgagtagctgagactaccagtgtgcaccagcacacttggctaactgcgtttattttttgtatttttttttagagatggggtattgctttgttgcccaggttggtcttgaactctctggtttcaaatgatcctcctacttcaacctcccaaagtgctggaattataggcatgagccattgttccctgtcccgtgttatttcttatgccttatatgtgtccagcttgattcagttgctaacaagtacagagaagcttctacatctttgttttttttcccctacatttttgttttgccaggtactattttaattgacaaacacacatgtacagtcgcacactcatttaatccccacaagagcactgtgtggtaagtatcactatcactcctgttgttcacatgaagaagcagaggcacagagaattgaagttactgtccaaagctatctgctataagctggggagctgggactccaggttccagagtctgtccacctcatcagtagcgacactgctcctcatgacttggatagctcctgggaacatgaatttgcagcccctgcactagaatcttgttcccagcctcgggtcagaaaggtggcttgaatgcactgcgttgagcgcagtgggcctgaccgctctctgtgcagctctgcacccctgtgggtagtgggatcatcattcaccaagatgcccctgcctgatgtaagatcaaggggtggagatgtcaacaaaaatgcccaccgaccccctcagactttgctgaataccagatagaaaaccctggagagagctgcatattcttatgtggcttcttagagtcacttgcttgactatgagtcaaagttcaaatgctggctcttgcacttgtggctggtgaccctggccaaggtacttcacttctccacatctcagtttcctcatttgtaaaataggggcagtcatggtacctgcctcatagtgttcttgtgaggaacgatgagttaatacagaggatgctgttgtgccccactcagctcccattaccaggcttgtgctccatttcccagctgctaggagtgttgggtgtcgtggctcacaggtgccccttcttcagggcactgctctcactagaagaaatctgcatcacctaggaggttgtagtggctgtaagccaagccaatgactgactggcagggaggacaagaggactggcctcccttccttcaggaggacctacttttccggtgtgattcatgctccagacatccccccgccactccctatacagtcagggtgaagcccatccctaagtgggaccacagccttgtttagctttattctgctcgccatcccactcctgcactctcccagtaaacacttgagcaagaattcctgactcaggctcaacttccagggaaccaacctatgataacatgcaaaacattagcactctgcctaacacagagtaggtgctctgtaagagttttgctatatagcatttatttttatcctcaaggatgaggctactgtatctgtaagacccttgagggccaggatcaagtacatccagcagaacatcgggcttatggctaatgcttaaaaagatcatgagtagatagtccatgttcatggataggaagactcaatattttcaagatatcagttcttcctggcttcatctatagattcaacacaatcccaaccaaaatctaatagagatacaagaaaaggtttttttcaattcacattcaatacagcacgaaacacttcacctcagagaaaggaaaaatcaaggtgtgttttttttctctttctctttcctcttccctctgtactcaacacttttgacaccagatgtgtatggttttccccccacgcatcaagcaaacaattctccattggacaccagtttggtgtcctctagttcagttcaattctgatactatctacttggagctagaatcagattccacaggttgagagctcagtccctcaagactctgtcccatttcaggtgccagtcacaagcccaagttgtggcctatgcttttgactgactggctataaattggggttccaataacccactccttggatttgattaatttgctagaatggctgacacaactaagggaaacatgtataccagtttattaaaatgatattacaaaagataaagatgatcagcctgatagaagagatgcatagggcatagggttcccatgttctctctgggcatgccacccgccagaaacttccatgtgtttagcaaccaagaagctctctaagccctgtcatcctgggtttttatgagagcctaattacaaaggcatgattgattaaatcattggccattggtgaccaactcagtctttagcccctctctccttcctggacgttgggggtagggctgaaagttccaaccctctaatcacatcgttggttcccctggcagccaaccttcatcctgaggtatctaggagcccccagccctacaaaaagatacttatcactgcagattccaagggtgttaggggttgtgtgccagaaaatggggttggagaccaaatatatgcagtcagtcctctgtatttgtggattctgcgtctgcggatttaagctatggtcgattgaaaatatttgagaaaattgcatcttactgaacatggacaaacttttttgttgtcattattccctgagcaatacagtataattatttacataacatttacattgtattaggtattaaaagtaatctagggatttaaggtatatggagggatgtgcataggctgtatgcaaattctctgccattttttatcagaggcttgagcatctatttggattttggtatctgtggaagatcctggaaccgatccccaacagtcactgagggatgactgtatatcttattaaaagtcacaatattacagaatcccagcaagttattctgtgggtagtgacaaagtgattccaaaggttatatggaaaggtggaagacatagactagcaaacacagcattgtagaacgaaatcagaggactgcaagacttactctaacgttccagtaatcagtacaggtgatgttggcagaagaatagaaagattagtagaacaggatcaagagcgcagaaatagacccacacaaatatcatcaactgatctttgacaaaggggcagaggccactcagtggagaaaggataatcatttcagaagtatgatgaataagctaatacttgtcttgggaagaagcaagagaggggtgttcaggatgataaagtcctggttgatgaaggcagatgcctgcagctctttcctggggcagggctggcttccaaagggtgcttgtttgggccctttggaagggggtgtgcggatgtgcagggctgcttgtatcattagaatggctgttagaatttcattctttctttcttaccatgctctgtctctctgcctttgtacatgtgcgtttgcatttctctccctccttgtctgggtaacctgtgcttttctgtacctggtctctctgtccctctctgtctcccttggtctcccttgtctcctcctctgtccttcttcctctctgtcccctgctctgctcagtcatcagtaatttgatccctcttgaggtccccatttctctctgtccctttcctctttccaagaactacttattgggccccgctgtgtgccagctactctgataggggtggagctcagtggtgaagaagggtgtacaatccctgcgtgtatggagcttacagtctaggaaaggagggctgtggatccacagattccatctaatacatatttgcctctgttgagtgctgtggaagagaggtgcttggtatagatcatagcaggcattgggaggttttctgagtttggtttgattgagctgagactggaagggagagcttggcactaaccagactaagaacattttcagtggtgccaacaacaccactaatgtcctatggtaggaatgagtgtgacctataagagatgcttggaggggcctgtgtgggtggtgcaagggctgggaggcagatgcttaggccacgtggggttggaggggtcatcacagggctgtggttcttagtccttacagcaatgggacgtcacgggaaggcttgatcccaaggagtggcatgagcctgtttgtatttcgtaaggtgactgtggggataacgtactgctttaaggagacaagtcaggaagctgcctccatagacaagagataatggtggcttggattgtggtgttggccatggaaatggatagacgttgacagattccagagcaatttcagaagtagaattgttaaaatctggctattgctggaagacaatgttaccttgtctaaaaaagtttttctttagttatgtataatttttctgtaaggacagatgctcaccataggccagttcaaagatcccctcttggctgggcgtggtagcttatgcgtgtaatctctgtactttggaaggccgagacaggcggatcacctgaggtcaggagttcgagacaagcctgacctatatggtgaaaccctgtctctactagaaatacacatacacacacacaaattttccaggtctggtggcggatgcctgtaatcccagctactcgggaggctgaggcaggagaatcacttgaacccaggaggcggaggttgcactgagccaagattgtgccactgcactccagcctgggcaacaagagcaaaactctgtctcaaaaaaaaaaaaaaaaaaaaaaaaaaccaaaaaaattccctcttgaagacattttactgggaaagagaattgttagactagacagaaagagaaaagaatgtttgcttaaagtcactagactttcactggcagtcaactgggtgggtgaataactaactttggaaaacaaaccttaatacctttcaagtttttagataattgctaaagcagttatatcagccatgttgatttcctctaaaaatgaattccagtgcctagtgtctttaaaaagtcaaaggcacaagagaaaacaaaagtaaacaaggagactccgtaggattgaagatgtaatgacataatgagataagatgtatgcattttatttgtcttcaagtctactgtaaaaagatttggagaaaactggggaaatttaaatacagatgaggtgttaggttatgttatgtaattatcatcagttttgttaggtgtaaggttttatggttctataagaaagtgtgctcatttttttgagataaattaagtattttggggtgcaacatcatgaagtctgtaaaagtactcaagcttcccccagataaatgaaacaaacaaacaaaaaagtttcagtgcacgaaaaggatctttctgtttgtttgtttttgaggagtgaagataaagagaagagataaggaagactcagatttctggtttgggtgaagagtggcgacatgtccatcttttactgaccgtgcgttcttgggctctcagtgtgatagaaattgacaagaggtccaaagagttttcccagacaaggctttattggagcttatgcccaggcataagagaagcagcacaagagaaagagaattctcttcctggctccccgaagacagtcaggagaggaattttaaaggggctaaagtaggcagggagtgatatttaagcatgtagaagcggggaacttctggcacctgcacagtgtaacagcatagagagcttcttcctgtgttgcatatctcattagcgtgttaaatccccacccctaggcatgatgtttagtattataatgcagccaaggtggaggactggtcattcttcagatctcctgcacatgcgggcaatagggttaactcccttgagtaagatttaagatggggcccgcttatttttgtttcctcgaggtctgcaatcagtgggaatggccctttgaacaagatttatagtgcaaggtctggatggggtccccacttgttatgggtccccccagccagcttgtagtagaagtcctcagtggggtgtgacgggggatgagtcctttctctactttctctcaccttcatccctaatactctaccccacaaggtttagagataccacccccctaataatagggccacccataattgagaagtgtctttagttactttttattttgaaataattttagactcttgtggacctggcaaaaatagtacagtttctgtgaaccattcatttagctgctccagtgataacatctttcataaccatagttatcaaaacctggacatggtcgctggtgcagtgctattaatgaaactgcagatcttaattggttttcaccattttttacatacactccgttttcttgttattttgcatttgttttggtgtgtagttctacgaaatcttgtcacgtgtaggtgggtatgtctaccaccgtacatgcacaggatgtagatgacgtgctgtttttttactcttttcacatggcctttttgttgttgttgttgttgttgttgaggcgaagtctcactctgtcacccaggctggagtgcagtggcgtggtctcggctccctgcaacctccgcctcccgagttcaggcgattcttctgcctcatcctcccaagtagctggtacaactggcctgtgccaccaagcccagctactttttgtattcttactagagatggggtttcaccttgttggccaggctggtctcgaattcctgacctcaagtgatctgcccgccttggcctcccaaagtgctgggattacaggcgtgggccaccagtgcccggcttgttttcacatggcttttgcccactgagctgtttctaattgagctagacccacggtaagaactcagaaagctttgagtgcatcccatcccctctcctctaacttaattgtctgctctcctcctctagctcccattgttgcctgtgaatggccacgaacctctcctgtgtttcactatgactctaagatgcctttgctcacctctggacttcgttctgtcctcttccttaattccaggccacagccacctcttcttgctgcaaagctgagatctcctttctcactctcatctccaggagtgctggagttcaaaggtacaccagggtttgataacactttcttccatggtagacaaggtggtccctgccactcccaggctcatgttttaccagcttgggagcagccgtggaggggaggttttaccagtagtcctggccaaataagtcccaggaggatgctgatggtgcagctgggccatgtgtctgtccccgaaccagtcactgagccagggcacttgggtcattccctggcccctgctgtcgccttcagcttgtggttgaaggtggtgggggtgaatcagctctatctaaagcacatggaatgggtgcatcccatgaaaagatgattgttgttgtagtttttcagaagaaagggaaagaagggactggttgagcttgttgagcttgtgtctctgtgccagtccagagttcactggtcatcttgtagggggaaggaggagtcacctttgagtcagtcaggttgctatccttgcctggtaggttttgaccaggagtagatggagtcacatggcagcagaagttgcagaacggaaggatttcttacttgtttctgttatctattgctatacaacaaactatcccagtgtttagtggcttaagacaacaatcattttatttattgcacatatttctacaatctgggcatgggtggggactgggagagcttgtctgtgttccacatgttgtcagctggggcagctcactggggccagaggatccacttctaagatggtccagtgctctgtggctgttggctgggggctcagctgggctgttggctgagggcattgattcttcttccatggcctctccatagggctaacttgggcttcttacagcatggtggtctccaggtagtctgacttcttacacagaggctggcttcccccagagcacaaaatggaaggtaccaggccttcttaagtattaggccccaggctgggcccgctggctcacgcctgtaatcctagcactttgggaggctgaggtgggcagatcacttgaggtcaggaattcaagaccagcctggccaacatgatgaaaccccatctctactaaaaatacaaaaactagccgggcatggtggcacatgcctgtaatcccagctactcctgaggctcaggcaggataattgtttgaacctgggaggcagacgttgcagtgagctgagatcatgccactgcactccagactgggtgacagagtgagattctgtctcaaaaaaaaaaaacaaaacaacaaaaaaaaaccattagaccctgaactggtacagcatcatttatgccagcgtgccagtgctcctaacctttttggtaccagtgaccagtttcatagaagacagtttttccacagatggtgggggcagtggggggattgctttaggataaaactgttctacttcagatcatcaggcattagattccaataaggaccacacaacctggatccctcgcatgcgtagttcaccgtagggtttgcgcccctatgagaatctgatgccgctgctgatctgacagttggtggagctcagataatagtgcttacttgccggtaccagtccatggcctgggggttggggaatccctgatttatactacattttattggttaaaacaggtcacagagacaacctggattgaagggcagctggctatataaggcataaatactggaggctgtggcccattagtaacagtccattactctggactgttaccagagtcatagtttaccactctcttctcacaggccctgtgatatccagaacccctgttaccatccccaacgctggggttggcctcttattattatttttaatttgaatcagttagtgccttcatttcctcttccccctttaattgagccacagagcatttgtagcttttgggactcaagggaaaaggtcatcaaggtcaaggtcaaccggacagttgacctttaggctgcctagagtgatctctagtgagcatcaatttggtctcttgtttttttttggtagaatagtctgtgcttatttcctgaaatctcagttgcattacaaaaattaattgtcctagtttaaaatgtgtctgtctgagaaacagggtgagcggaaaccccaaactcttcagactccaggggtttgtggggtggcagcaaatgcccgggtagggtcttagccctttgtccatttccagaaggaggggacactgagtccagacgcagagatagctttgcgggatcctgttggggaaggaaggagccaggctgtgcctgggctgcagttgtgtggctgcatcctcaggtggagggaactccagcttctaattggctcatgttaatttcattttagtggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcaggtaggtgcatgtttctgtgcctttctccttccctgtgccttagtgtcttcctgaagaagttcgctaatagcagaatgctcacccctgcctgctcactgatgtgtatttggggtcatggttttgaatcccagccctgcccctttctagctgtgtgtctttaggtgagtgacttaacctctctgagctgcagtttgctcagctgtgaaatggggagaataataatgcctatttcatgggggtattgtgaggagtatgttaagtgtctctctggctcatgctgagagctgaataagtgatgattagatagttttaacactgaaggccaggctctgttggatgaaaaatgtacgctgggctcatccctgtaatcccagcactttgggagcctgaggcgggcagatcacttgaggtcaggagtttgagaccagcatggccaacatggtgaaaccctgtctctactaaaaatacaaaaactagctgggtgtggtggtgcgcacctgtagtcacagctatttgaaaggctgaggcacaagaattgcttgaaccagtgagccaagattgcatcactcccctacagtctgggtgacagagcaagactctgtctcaaaaaaaaaaaaaaaagagaagaaaaagaaaaatgtaacctgttttcttccagcagatgtggctcagcaaatctgattgatctgaaggaactgtcctgagatcttctgttgcacacacacatgcactttcctcactttactcaggggcagaagcttgtatctactttcaagttcagtcctagaatttattgacttagaagtatatgtatattaattaagaaaataaatacgattaaaatagaccaaagtgggtgaggcagctgtcaaagttgagcaatatagggacatttacttttcggtcaaataacttattaatttctcattcattcttttactacatgtcttttgagcctatactctgtgttaggttgtgtacatgccagtgagctaggaagatgaatgggacctggtgccgcctttaagaagctctcagtcgacttggggagacagatgtgtgtactgggataagacctagtgcaagcatgatacagtgtgctgtgaatgtttaattccagggaagcttggcagagaaggtgacttttacattgggttttgaggcttcagtaggagtttggaggaaagagagggagggtgctccagggaaaggctgtggtgtgtgccagggcttggaggagggaaatagcatgtcggatgtaggaaatgaggagcgaatgtctgactgatgatatggagggggagttggtagagatggggtaggagggcaaggcccgtggcggtgaagcttcacacctctgtctccttagccccacctgcaggctgagccctgaccccctgttcttaatttggtaaggagaccagaagaacccgggtcttggaagccaggatgtgaactttgatatatatcccactcttggtccctcttccggaaccctaaattcaaggtcagcacagtgatggtcaagattttgattcacattccatcttctcacttactggctctgagacaaactcagcccttcagagcctcagtttcctccgcatctgtgtgggaagatgagagcagcagtctctgccatgggtgtacggactgataaagtacctggtgcttaaggagaggcttcatagttccatgaggtgtttgcactgttagcttcattttacaggtgagatgaggcacagagtagggttaagtaacctcctgaatgttacacagccctgaagtggtgcagtgggacttgagctatgatcttccttttgccagatgccaagctcttaaccactcctcaatgccgcttattaacaagggtaatagcaaccatgggtattagcaagccatactctcctgggtattagcaagctctacttgctgtccctctgtgccatcttgattagaagcaggggagatactgacagctgcttagggttgtggtgcagattattccagattctgcattttattagttagcatagggttaaaagctaacactctttaataaaacaaaaagctaaatccctaagccagtggtactcatccatgggaagctgaatactgccctcccacgatgcccatgtcctaatcccgggaacttgtgaatatattatcctctatggaaaaggagacttggcgggtgtggttaaattgaggatcttgagatgggaaatatcctggactatctgggtgtctagtggaatcacaagggttcttagatacccgggaaggtcattcccagagaaagagatgtgaggatggaaacaaaggtcagcagatgagaggccatgagctaaggaatgtaggcagcctccagaagctgggaaaggtgagtaaacagattcttccccagagctttcagaaggaattcagagatctcatgcaaccagtctattttagacttctggcctctctaacagtctgaaaataaatctatattactttaagtcactaagtttgtggtcatttgttatagcagcagaggagactgatgactgaacctttgatatactttggcaccaggcaggtgtttccacctgttgatgtctccgtcatccctctcttctggtttaattactttagggtgggacctaagtattggggttttgaaaagccttcaagtgattctcctgagcagctggggttgagaaactctgctctggagttggacacctgggtttgaattcctcagctttttcatccctggagtcagtgtgctgccagggtaagataatggattcttgtttaaaatcctgtatcttccactgtctcagtgtgctctggctactgtaatgaaatgctgtagactgggggtttaaacatcaggcatttattttctcacaattctgggggctgggaatgccaagatcaagatgctggatggttgagttctggtgagggctctcttcctgacttgcagacagctgccttcttgccatgtgctcacatggcttttcctcagggtgtgcttggatagagagggagctctagtctctctttctcttctctaaaaaggcattaatcccctcatggaggccccactctcattacttcatctaaacctaaatacctcacaaaggccctacctcaggggttagagattcaacatatgaattcggaaggaatgcaaatattcagtctgtaatggctgctatgagctgtgtggccttggacacatgactgaacctgtcttaggttcagtggtttctccatgtgttaaatgggaatataatagtacttcccttgtgggatcaatataggaaaaacacttagaacaatgtctagtatatatatgtagttagtgctcaaatgatgttaacaatgtcatagtgatagttcccaccactccctccattcttagctgattccatttggcacaggaaataacccacttgtcatccctgtggtacaaagctcatcatgaatgtgtggccccatctcagacaaaaagcaggtcctagggccatgacggtgtgaaaggggatgctttctttgccttctgcaaaactagaaaccagcataggcttctcccatcttcgtgatctgtatggggcagggctttgtaagcagacgtcttcccaggaattaacacagcatttctgttccctttctccactccagctgactctaaagaggatgcagttaactggctctctggcttgaaaatcttacaccaggaagcgatgaatgcgtccacgcccaccattatcgagaggtagttggcttttgcctgttgatttgcgtagttgctgattcctttattctgctgcctttagccaacatgggctacaggggggaaaaaaaaaaaaagggacattggttttttgaggctcgttgagtgtcttgtatgcaatgggtgcctagtagcggtgtgggctctacagtttttcaaataagagcatttccctgtgctagttttcagcgttggcctattggagtgagtggtgcattggactcgagatagaaacattcctggggtatgtgctgggggaaaacagggcttccttcttaaaggatttaataagagattcagtggactgatcaaaggacagatacagggtctggaattttccacctatcactccctcctgggttgatgaagacctcaagactgtctcttcagtgtcatgggagtctagatgggcattggggtgtgagttattttccttccactaaatcaaagtcctctactttttactatttttctttctagctttttggggattaaatgactatcatcagaaggaattgacaatgtaaagaaacctggcctttttgagttgaaatcttggcttagataggccttttccacactaggaggaaactgcttcccaagctgcccttgttagaaagttggaagactcctccttttggttccagttccttttgtgcacattccgtaggactcacttagacttgtgctattttctaattttctctttctctctttcttttgtctcatatttctttccagttggctgagaaagcagatatattctgtggatcaaaccagaagaaacaggtaagagtcattcagtttttttctgatcactttggatttcgatcctcattctatctttaaaccttccaagggggtgggagcatgacttgtcgggagcaaggtcctcactgcgtccattgtgatctgcggatgccatgttgggtcctggggttgaggatgacaaaatcctcctcctggagggagcctctattccgcagaaaattcaagtacagcctcagagatgatctctgccatggggcatttggacctcatcacaaatatttgagcacctttaaagtcctggtaatacagcagtaaccacactcctgatggcaccagcccatgctttgtgacaggagagagattgattgaccgtgaagaagtaaaccaggtggttcttttttttttttgagacggagtctcgctctttcgcccaggctggagtgcagtggcatgatctcagctcactgcgagctccgcctcctgggttcatgccattctcctgcctcagcctcccaagtacctaggactacaggcacccgccaccatgcccggctaattttttttgtatttttagtagagacagggtttcaccatgttcggcaggatggtcttgaactcctgaccttgtgatccgcccaccttggcctcccaaagtcctgggattacaggcatgagccaccgcgcccggccaccaggtggttctaagggctggtagagatgtgttgggtgatgtgataacgtatattcagtttacttgactttttcacttaaaagtacctcttggagaagctccctatcagtcctgcacaaagctctatgacggactattattattattttttagaggcagggtctctgtctgttgcccagactggagggcagtggcacagtcatagctcgctgcagccgtaaagtcctgggctcaaacgatcctcccgcctcagcctcctgagtagctgggaactacaggtgtgtttcaccatgcctggcttatttactattattattattattattattattattatttttttttttttttgtaaaggtgaagtcttacccagacatttttttttaaaaaaagcaaacgcagttttggtttttctttagattaatgcattgtcatttcggaaatcatttccgtgttgatgcacagagcgctgctcccaatcctttatcattactgtgattaatgctgctgtggaaacctttgggtctatctttctgtaaactcatttgagggagctgtgagtggggtaaattctcagaaacgaataccagcagcacagcgtttgctggtctaatagtttgatagcgagaggtagcaatttgtataatatttctaccagtggggcaagagggcaccctttcctgatgatttattgtgccattagactttgatctttgttcatctgcaaccgaggcaaccaagtgtttttgcttaaacttgctttctttatgggtgaggttgagcatttttaattcattatgtttttgaggtatgattcagctcttgataatgtaatgataaaaactaccatttggccaggcgcagtggtgtacacctatattcccagcactttgggaggcagaggcaggcagattgcctgagctcaggagttcgagaccagcctgggcaacacggtaaaaccctgtctctactaaaatacaaaaaattagccaggcatggtagcacgctcctgtagtcccagctactcagcctcaggaggctgaggcaggagaattgcttgaacccgggaggtggaggttgcagtgagccgagatcgcgccactctactgtggcctgggtgacagagcaagactccgtctcaaaaaagcaaaacaaaaccaaccaaacaaaaaacaacaaaaaaacccaccacgacaagaaaaaaccaaaaaaaccaaaaccaaaaccaaaaccaaaccctaccatttattgaacaaccgtgtatttggcatgccagggattgcattgagctcttcagtccttgtctcatgttagcctcacgtgaggcaccttatttttttggtaaaatattcctttcattcattcttgatttatttatgtcattatcctatgtggatatgtcattatcccatctagatgtgtcattatcctagttaatatccaataactaaactctgtcagctctcttattttgttcctgaaaatctttccatcttgaaggtgacttcgtgtctggtcagtgtcctctgttacttgttagcttcagggtttgggtgagcttccctggtttcttcacatgcccgatgggaggatttggaactattaactaggaagtggttaaaagtctagtaatgttaggtcagccattagctcactccatgtttttctgtccacctgcctttctctccgtcctcttcttctcatccaaaatgccctgcctgctccgccacgctgggccaccctctcgtgttactgaggtggatcaaatgaggtgcttgtgttggaagatttggtacacactggtctctttcagcctcggaggtgatgcctcttctgacttttctttctctgtggcttatgatgattcatagctgagattggcacagggctgagagagggagccaccctcagtgcctctctccacgcggtgctggtatggtatggccaatctggctctgaagtcggctcttcgtttgtgaggtcaagaaatggataccaccctcttgctcaggaggcattctggcaagtcctgcatagagatccatcttcccatcggctggtccaggaccctctgcagagagaaacttttctgtttctggactgagttcatccctgtgtgctcaccggcttcctctcctctacctccctcccagtgggcagagccctgctctctgtcaacatgtggaaaatcccacctttcctgtggttctgggaagcctggagggagctttgcaaaagaaactttgaccaagatgccaatgaaagagcaactgacttctgtcctgccaatttccctccctttcctgtcacccacgagacgaatcgtgtttcctgaaggaaaacaaaggagccacagaggcagaggaaagactgaaggcgagagggggcaggctcagggctggcccagcccgggcaatggacaagtcttaggtgttttgcttggcccaagcacgctgtttcattttttgacttttctagaggcaaatggtagcagcgggcatttgtttacagccttctttgcagccgtggctgtaataagcactttacatccttaggatatgctcttggctgacggttgagctaggtgctctcagacacgttttctatgtgaggacactgaggcccagagaggttaagtgacttgactaaagcagcccaggttgtcaggggtggcaccagggtttgcagacttactttccccactggtgttgcttttccttttttcttttttctttttttaaatgtgctactggccgagcatggtggctgacacctgtaatcctaacagtttgggaggccaaggcgggtggatcgcttgagctcaggagttggagaccagcttgggcaacatggggaaaccctgtctatacagaaagtacaaaaaagttagctgggtgtagtggtgcacatttgtagtcctgctacttgagaggctgaggtgggaggatcatctgagcccagggaggtcaaggctgcagtgaaccatgattgtgccactgagctccagcctgggcaacagagtgagatcccatctcaaaaacaaaaacaaaacaaaacaaaaccaaaaacaacgaaaataaaaacaattgtgctgttgagagctgggggaaatgcagaaatcttcccttccccaccctgaccaatcaccttatgattaaaaaaaattaaaaacaaatgttaaaatttgttttattgtggtaacaacaatgaaacatagaacaacattgatcattttaaccgttcttagatatgtacttctgtgggatgaagtatatcatgttgtcatgctcccgtcaccaccatccatctccagaactttttatcatctcaaactgaggctctgcagccattaagcagtaactccccattgattctctctttagcccctggaaatcaccactctactgtctgtctctctggattggattgctccaggtacctcatataagtggactagcagaatatttgtccttttgtatctggcttatttcacttagtgtaatgtctccaagtttcatctgtgttgtagcatgtgttagaatcttcttcctttttaaggctgaataatattccattgtacagatagaccacattttgcttatctacttctccatcgatggacacttgagttgcttccacgttttggcaattgtgaatagtgctgctgcgaacatgggtgtacaaatctgtttgagtctctgctttaaattcctctgtgtatatatccagaagctgaattgctggatcagttgctggattgctgtgtatatatccagaagctgaattgctggatttattttgccggattgctatactgttttctgtagcagctacaccttcccaaggcagtgcacaggtttctgttttcttcatatcctcaccaacacttacttcctttccctcctctgcccttgcccccttggcgtataacattggatttgcataagtagaatgtgcacttccctttgtcctttagccctggcagggacagaggaactactctaccaggaggtggcaaagggtgagggggttgcaggtggaaggcaggtgggtgagtccatttatctcattcagcgtgaatgcaaataggcttcctatttgagactccagaatgttagagtcacctggggaagctttggcagagccacggcagtagtgattcgggttttactgttctgggcatggcctctggcgttgcaaattttttaaataagattcttctgtgaagctggggttgaaaattagggctgtctagagggcaattttcaaatctgagcatgcaccggaatcccctggaggatttgtgaaagtggaggctgctgggctccatctcacagtggctgattgagtaggtggtgggcagggctcaagaatttgcatttcaaccaatccccaggtgatgtagatgctgctggtctgggagctacttagagaagcagaactctggggctgcgctgtccagcagggcacccctcaccacaggtggccatttcaacaaaacaaaacaaaatgaaataaaatacttagctcctcagtggaactagctgcatttcaggggctcagcagccccgtgtggctagcagctactacctcagacagcacagatgtctccatcattgttgaaagttctgtcagatggtgctgaggtttaaatctcagatctcacactaactcattgtgtgaattggggtaaatgatttaatttctgtgggcctcagtttcctcatgtgtaaaagataaaataatagttcccgcctcccagggcagatgtgaggcttcaggagttaatatgtgaagggtgcgtggacctgcctggctcatggtaaacacttgacgaatgtttcttattgccattgttgctacaaaagagccgggggcagtggaggtgccggcccagcctcagcatggctggtaagtgtcacggggctgccatccttaatggtttggtgatggctgcctgggtgcgggagttgaagaaccctgggggcctcccgggctgagcagggaggacactgtgattgttcagtgctgtctgccatgggagagggaggggctgttggtaactcattcagggaatagttgccgtccttctccaaagggattcccttgtttcctaacccacagccctaggttgagctcccaggaaacatgatctgagacgcaggtttgtgtgcaggaggcttactagggagtgcagggtcatcaccctgggggaaggaaggcagctggaacaggcagctggggagtcacaaccatggcctgggcacacctgatggggagctctgagcatggcctgtggagctgtcctgaattgagactagagggccaggcctttgttcccttgcgtggactgggtcagagctggctgccttggaaggggctttgacctgggcgaggcactctctgtaggggatggcaggttgcagagaggggtgaagctgagccgttggcttcctcccctgcagcgatgggggctcagcctgcctgtgctggttttggtcgggctgtgcagcacgacacacacacatccagaggtgggagtgagggaggggctcgcctagggagaaagcgggtgaggctgtcccagagctaggagcccaaagaagctctcagcctccagtgtttacattgtaaggggaggcctttggaccaggtgggctcccatgtcccaggtgcttggatgctcaagcccctggttcctgggttttctccacttgttcttgagcagctgctctggcaccccaggcccctcagtctctctgttcctggacatgggatggttcctttgccctgctgctgtctgggctcctggggggccctggcctcttccttgctcccaggatgggctccactggggcaccagcatgagaggacgctggcctctcccttgctcccaggatgagctccactggggcagcagcgtgagaggacgctggcctctcccttgctcccaggatgggctccactgggcaccagcatgagaggacgctggcctctcccttgctcccagggtgagctccaactggggcaccagcatgagaggacgctggcctctcccttgctcccaggatgagctccactggggcaccagcatgagaggacgctggcctctccctttctcccaggatgggctccactggggcaccagcgtgagaggacgctggcctctccctttctcccaggatgggctccactggggcaccagcatgagaggacgctggcctctcccttgctcccaggatgggctccactgggcaccagcatgagaggatgctggtctctcccttgctcccagggtgagctccaactggggcaccagcatgagaggacgctggcctctcccttgctcccaggatgagctccactggggcaccagcatgagaggacgctggcctctcccttgctcccaggatgagctccactggggcaccagcatgagaggatgctagcctctccctttctcccaggatgggctccactggggcaccagcatgagaggacgctggcctctcccttgctcccaggttgagctccactggggcaccagcatgagaggacgctggcctctcccttgctcccaggatgagctccactggggcaccagcatgagaggacgctagcctctccctttctcccaggatggtctccactggggcaccagcatgagaggacgctggcctctcccttgctcccaggatgagctccactggggcaccagcatgagaggacgtggcctctcccttgctcccaagatgagctccactggggcactagcatgagaggatgctggcctctcccttgctcccaggatgagctccactggggcaccagcgtgagaggacgctggcctctcccttgctcccaggatgggctccactgggcaccagcatgagaggacactggcctctcccttgctcccaggatgggctccactggggcaccagcatgatctggctcctctccccacgacccctctcgctgccgctctggtagcgcctgttcccactgctcctccaccttcatcctgccctggcccagctgttccttggaccactcccagggctgaggcagaaaggttcttgcaagcccctggggcaacttccctagcctgctggccgctgtgcccagccagccccagctggcccaacagggactttttctgccctcaaggtctgtctgtgaaagccgtgggtgctgtccctgtggtaccagtaagtgggtggggagcatcttgtcatttgaagtctgtgctgttacagaggcccttagaaccagaggaaaggctggaggtggggacacaggatggccagagtcacactggaccgtctccagggcagcggctgggcagtgacgcgctacttccttccgcatgccacagcagaagctgggaggatggtacagggaaactaggtggttttctcctgcaaggtggggcgagcttcctctcttgaccactctgtctcagctctgctggacacttggctccagccagaagggtctggatctcatattcttgacccacccaccccactaatttcacttctccttcttgtgtgagctactcgcttggaggcagtcaggtgtggtcattatgggcacactgggttggagtttgaggctagcacagataaggtaccaaactgatcggtgcctcagtttcctcacctggaagatggagatgatcatggtacctgccttgtaaaattgttcaaacatcaaacaggtgaatgtgcatataaggcaccacctagaacaacacctgtcacctgataagcactattgaagtttcagcttttgttactattgttactgctgctgctgctccttttgcctgggacgtgttctcccttgcttccctcccttttcttttttatttttggagatggagtcttgctctgtcacccaggctggagtgcagtggcgtgatctcggctcactgcaagctccgcctcccgaattcacgccattcttctgcctcagcctcctgagtagctgggactacaggcgcctgctaccatgcctggctaattttttttgtatttttagtagagacggggtttcaccgtgttagccaggatggtctcgatcctctgacctcgtgatccgcccgcctcagcctcccaaagtgctgggattacaggcgtgagccaccaccgtgcctggccctcgcttcccgcttcagctgaacctcactatgtggcttcgaagaaacactcatgcagattcctgtgaccgagcactggaatttgattcaaatccaggctctgctgcctgccatccagctctaagccctgagttgtgtacccatgtgacaccccacccttggctgttctgagccctgggggtcaaccatgtgtactttgcagaaggtagaatctggtgaacaattaggcaactttaatgcctggatgaccccagggcagcctggcacacagtaggtgctcatgtaggccttgttccttcccacttcccctccctggcccttagtgaccttgccttgctctgaaccccagtggcattaaaagaaacctttatttttttacttatttttgggggtgcagggggtccccacttactctgcatccctcttgtctcttcacagtgtcagactagagtcaaattcagctgggtctttcctggctgattctgccaagcccgtcctgtggttttggttcctctgggtggcaggtagagtcagtaggagtcttgttcatccattcatgtgtgtcgctaattaggtgacaaagcatttggctacatgaagagtgtcatagttactcctgatgtttacccaggcttcattgaatttcttcactttgacattcagagtcctgggcagaaatcacatcatgtcaacacctatattgggcctttggcatttctgtggcattttgtattgagattatctggtcatttgacatcattttctgcccacactgaatctcctgcaagaccttcctccatgaccattcctgaagggtggagaccagcccttctcactgggacatcaccctatactggggatctccagtgtaggtgcctcctcattggggcatcactgtacgctataaatctcttatgtgacctatgtccctggacatacctgaagggtggagaccagccctccttattggggcatcaccctaccctgtgagtctgctatgtgacccatgtccatggacattgcttgagccttgctcattgaagtgtcacccttaccttgactcaatgtcttgttcccagttagtggtccataaataactgttgaccaggctctctcatagagggctgcctgaggtgggaactgatgggagcagctaaatcctgtgctgttgaaaaccctcaaggtgacagaactgggtctccctcttttgcagcatcagtctccgagagttgaagaccatcttgcccctgatcaactttaaagtgagcagtgccaagttccttaaagataagtttgtggtaagtttcatggctcagcctgggaattttatgaatgcggagtgacttagcctctctcatgaagccgtggcttgcctttgagttccgtggaatagtgcacaagaaaatcctttgcctccagagtacatcttagttcagacagagggatcatggacatatctgaggaccatcgtctcaatcctagcagagaatgtaatcaataaagaccatgtttactgagctcttggacttggaacatctaccctcagacctgttttccattagtccagctttccctatttccctgaccatactgcagcccattttttccctagtgaaatgaatgcatgtatgtcttttggaaaatattatgaaagattccttgtgtagggtaccaggaccgtggcattttgtatgcaagtcctggtagtgtagctgtcagagttggctcttttttcttctgtttctccaaccatccatccttccatacatcattaaatttattttgttgtgtaatcaagttattggtgggtctgggcagtaaagccactccatgagtgatgggatatagtagagcaggtgaggcaaggatggagacaatgggcaccgatttttgcttacagggaaatactcattcttcttaggaaatgagcaaccctgcatccaaacagccccagttggaggactccaatgcccattttcaatatcagctccattacaaggttcctcagtgcaaaaagctcatttcatttttgtattaatgagctcctggaaaaattatcccattttattgcttatcaagcatcctttgacctgcccccaatattccacattaatccaataatagaaaaagagaaaagggtaggtcagaagaggagagagatgggagaagcatttaccattgattgctacacagttgccatttaattctttatcaagtatttactgaaccaggtgttttgcaggtatgttgttcactttcagggaagccctaggagcatagtagtggttctcccattttacaggtaaagaaaactgagggtttgaaagggtcaaggaaattgcccaaagccataaagcaattaattggagctgagttctgtctgactcccaatgctttacaaaatgacctatatgtacgtactctacaaatatgtctgaagttggaagtccaaagagagtgttttctgcccaaaaaaggaggagttacgcatcatgtctcttggaaacctggctgagactcttcccttttggggctcaaaggagggtcttacttggtaggtgtctctgtgagtatgttttcccagacagggggattagggaacgtgtggagggttttgattcagaggaatatgaatttgattttagccaatgttgtagaaaagccatgttaaatagcatgactttttcctttcaaaagccatgacactgaaacaatgtggtcatagctgtctcttcagcatgccaataaaatagcatgccatttctgaaacaaaaattattctataaatagcatggagccattcttacggtggacatcaaaaatcatgtggtcacttttttcatatttacaggaaataggagcacacaaagatgagctcagctttgaacagttccatctcttctataaaaaacttatgtttgaacagcaaaaatcggtaagatgattcttgagcaagtgatcaagtgatgtttctgttttccatgtatttccaagtctggcatgttcctaagaaacccacaagaagtgttgaatctccattttagtcaaggaaacataaatgagaatgatgaaagcataccattttcatccattagattggcaaaattctttaaccatgacagagctgtgggcaaaatgtagagaaatggtgttcatatgccttcctggtggaaatgcgaatggccataagtttgattggaatttgatctgagtctgttaaaaaagtgcaactcactctactgcattatttcattctgaaaggaaatttagcaaatggctgttattattaatagccatctccagattgaggaattatatatatgtttcttctttttacacgtttgtttgtttgttttgagatagagtctcactctgttgcccaggctggagtgcagtggtgtgatcttggttcactgcaacctttgcctcccgggttcaagcgattcttgtgccttagcctccccagtagctgggattgcagacgtgcgccaccacgcccagctaattttgtatttttagtagagatggggttttgccgcattgggtgggcaggtctcgaacttctaacctcaactgatcggcccgcctccacttcctaaagtgctgggattacaggtgtgagccactgtgcccagccctttatatacttttattcatattttttatgagggcatattttttgattaaaataatagactatttaaaaattaagagggtgtatgttttgatctgacagtggcatcctggggactctgttttatgaaagggaaaacatcggggcctgagaatatattatcggattgtttattgcagcattacttatgctggcaaagtacctgggcaccatctgaatgtctcaatggaggaattgctgggtaaattatggtctatccatattatgtgacattatgcagctgattaagaagcatgtgtcagttctctttccattaatctgagatgatatttgtgacattttgtgatgaaagccagcagcagatttacatcaggagtcaggtctgctattttgttaaaaatcatagaatacaggccaggtgcagtggttgacgcctgtaaccccagcactttgggagcccaggcgggtggatcatttgaggtcaggagtttgagatgagcctggtcaacatggcaaaaccccatctctactaaaaatacaaaaattagccaggcatggtggtgtgcacccgtaatcccagctacttgggagggtaaggcaggagaatcacttgaacctgggaggcggaggttgcagtgagccgagattgcactactgcactccagcctgggcaacagagtgagactccatctcaaaacaaacacaaaaacagagaatgcaataatcctccttttgctcctttttatgagcaaggggagagtatggaagaaagcacctcacatttaatgttgattttgtgtgtgtgtgctggaaggggttgggaagataggcaggaaggatagttaccttttctttgcacagctcattttctgtgatatgttccaagtaacatgttacctttgcaataaaaagttccatagagcataaagttttaaaattgagactattctgtgcgatgcacctagcacagtacctggtaggtggcacacattcaataagtaggggctgctgttgttgctgtcaggaaagggctttgcagactgcaaaagagttcccagagaaaggtgtgagggcttggggagtacctggaacttggagtcaggtggctgtggtttctgcagttagctgcatgatcttggatgaaccactgactgctcctagcctcagtcttctcctctgtgcaatgggaggttgggagttgtgaagacaggcatttttaagtgatgagcatgaatgttcctagaagacagtcattaattgctttctgcatgcagagctgtgggctggccacacagtgaggccacctgatgggtgaccactggccgtgggactttggatgtatctgagttagagaaatgggagggccatttcctatctgcccagatttggggaaaacatatttcttagagtggatcattgaattgcaatgtgttcattttttctcatatataataattagttatttgtttgccaaatgaaatagaaagattgcaggcttgggagttgggagaactggattctagacccacttgacctctaactgaccaagtaatgttgggggaagccatctctgtcctctcacttagccttttctataaaatgaaggtattaaatgagatcaatggttataaaacttttaatactctttaatcccctctcctttagacaggaaactgtaacaaccacaacaaaaaccatgattcataaaagcttatcagaatactttttaaggttaaaacctgtaactttaaaaatagtccttgagaacaatgacgtgtgtcattgaacatagaacatgtcatagaataatgatgacagtgtgcgtatgaaatttggaatggtgacgattgtcatcttatgcaattgaccaggattgagaaaagctcgatttactcaagataagtagttgcaaataacagtttttttttttttaataatagtttaccttgaaatttcaagatgctgtgttgtcagacagatgtcaggcaaagtttgaaaataagatttgcacatggctgggagcagtagctcacgcctgtaatcccaccactttgggaggccaaggcaggaggatcctttgagctcaggagtttgagactagcctgggcaacatagtgagacctagtctgtattattaaataatattaaaaattaaaaaaagaagatttgcacaaaagctgtttcacctgctaccagattaacccattcattgatggtttccactgtggtaacattccacatgagaggtatttcaacctgtactttaattatggctcttattaaggctagtctgtgtgtttgtgtctatgagggagaaacataaattggaatcagagttttacaaaatgtcagaaccctctggggtgccctagattgccccgtgtggaactttgtatggcaaagattctgccgataccaaaggttgacccctggtggccagaatgccacattgagcctgcccctggttgtacttgatctaatggtttaaatatgttaaaaattaattgcctacatttaaaacttgagagattatattatatattaaaatctagatatttggcttcccttaggaaaaaaatcgagatctggctataaatagggtcacatctcgccatggaacggtccactttctctgtattgacccagccccatacagctctgtctgctcatttatgttgcttacctgaccccaaagaagttttgctttggcaaccctcatctccactgtttgagggtataactctccagtttggtcactgcattttaaaaatttaatttagtgacagatttgaataacaaagtcccaagctatgtagatggcttctggccagctctaagaacctcactgctgttgtgtaggtaaatgcccatcccctaacctgttagcaaattgtttacttcctgttcctggctggaagcacagggcagagaaaagtacctgttttgtgatttggggggaatgagggcctagctggatttctcaggctcctgcaggagacagagctatttatggtgacttataatccccagaactaaatccagggagtgggttcatgcttatcagcagccaaatggtttccatcgtgagcttgctagttcctctttgtgtctaaccacctgcctacgttccacctctcgagcttcagagtttccaaaagtttggcagcagcaggaggataagaaatgtaatctcacgtttgtgtctccctggtgaggggatatacctctaactaggctgtaataacagtatcattaacaaagatgatagccaacattttctcaggtggactatttgctaggcactatcctatgtgtttttttttttttttttttttttttttttatttgagacagagtctttctctgttgcccaggctggagtgcaatggcacgatcttgattcactgcaacctcttccttccgggttcaagcgattctcctgcctcagccttctgagtagctgggattacaggcatgcaccatcacgcctggctaatttttgtatttttaattgaaacggggtttcaccgtgttggccaggctagtctcgaactcctgacctcaggtgatcctcccgccttggcctcccaaggtgctgggattacaggtgtgagccatcatgcccaacctgctctatgtgttttgtatacatttaattcccccctagaggcctgtgcaagagctactgttgttattgccattttagggattaagaaactgaggtccagagaggttactttgctgaaggcctgtttactgcagggtagtaagctgcagagctaggatttgattttctgcccaactttgacgcatagccatggaatacttcttaatttttgaatcctttgtattaaagaaaatgtaaagcatatagaagtagagagaatagcgtaacagacccccatgtatcatcagctgacttcagccattatcaccttgtcactgccctcacccaagtcccttttctcacactttgcagcagacatcaagcagcgtatcaggtcatctgccaatactgtaatttaatacctggctacgtgactgctaccctgctacctcctgatcaaacctgtgaagtcccctgtggttacagcattcttacataaaaatagaaagcacttgcaaaaaatcaaaaagaaaattgagaaggctgctaacgtatctctggttgttcctatgatccagtaaggcattgaaggattattctgccggattttacatgggtgtgagcatgggggaagtgagtgatgagcgttctgtgacgatgtttgtggaggagctcagagatcttgcagtttattcttattgtcagtggctggcaagaggagagtccacagtggagaagttagatagaatctctggttagcttttctttttctttctttttttttttttttttttttgtttttgagacagggtctcactttgtcaccgaggctggggtgcagtggtacaatcatggctcactgcagcctcgaactccctggctcagatgattctcccacctcagcctccggagtacctgggaccacaggcgtgtgccaccatgcaggctaatttttgtattttttgtagagacagtttcaccatgttacccaggctaggcttgaactcctgggctcaagtgatccacccgccttggcctcccatagtgctgggattatagacatgagccactgtgcctggcctagcttttctattgatgagattttacccttggccttccagaaccaaatggtttctacagcctaagtaccactgagtgcgtaagaccagcttcggttgtgaaagggcgtgtgccttcagccacgtgggaaaactccattcctttccctccctttcttagtgccctggcccctgcttctgtgacccccgcctctggcatggccccttctcttgtccagctggtaacttctcctggggcccgactcagagatgacatttccctgtagccttttagctaccagaagaaattagtttatctattattttagtcactcatccagtaaatgtgtgcgtgacccaagaggcacagtggttaacaatacagctgtttctcctgacctcactggccctttgctggggtgggaaggtcctgggatgttgcccagagtgacataaggcccagtgccacccctgtcccttggttaggtagaatctgaccacataaccctccatggtaatgccgaacataaattaactgctgcctccacggtgcacccgtagcatctagaatattctgtgattgctggaatctcatttattgtgtgtacatatgtacgtgtagtgtgggatgctagagatttaccaaggtgggcctgggttgaaattctggcccttggacttgttaggagaaaagtccttgcctccctgggcctgtttcttgtttctgaaatggggcttattttactacctgatgggatcagcaggaggagtgactgagactgtcaccgtcttgccccagctcatggagcccatgttcatttcctggggccgctgtggcaagtactgcaactcgtggcttaaaaataacagaagtgtcgggcacggtggctcacgcctgtaatcccagcactttgggaggccaaggcgggcggatcgcgaggtcaggagatcgagaccatcctggctgacacggtgaaaccctgtctctactaaaaatacaaaaaaaattagctgggcatagtggcgggtgcctgtagtcccagctacttgggaggctgaggcaggagaatggcgtgaacctggaggcggaacttacagtgagccgagattgcgccactgcactccagcctgggcgacacagcgagactccgtctcaaacaaacaaaacaacaaaacacagaagtttattccctcactgtactggaggttaaaagtccaaaatccaggtgttggcagggccacacccctcggaaggctccagggaaggatgtgttccagacatctttcatggcttctagtggctgccagcaatgcttcaagcattcctcggagtgtggacaccgcctggctgctggtggctgccagcagtcctacaagtgttcctcggtgtgtagatggcattgctctttggtgtgcagacaccatcactcctcggcatgtaggcgtcatcgcttcttggcgtgtagatgtcattgcatcgctccttggcttgtagatgtcattgcatcgctccttggcttgtagatgtcattgcatcgctccttggcttgtagatgtcattgcatcgctccttggcttgtagatgtcattgtgccagtctctgcctccatcatcacatggaccccttttctctgtgtgcttctctgtctccaaatctccctcttttttttttaattttttttttttttttttttttttttgagagggagtctcgctctgtcacccaggctggagtgtagtggcgccatctcggctcactgcaagctctgcctcccgggttcacgccattcttctgcctcagcctcccgagtagctggggactacaggcgcccaccaccacgcctggctaattttttgtatttttttagtagagatggggtttcactgtgttagccaggatggtctccatctcctgacctagtgatccgcctgcctcggcctcacaaagtgctgggattacaggtgtgagccaccgtgcccggcccaaatctccctcttttaagaagccaggcactggattcgggtccaccctaacccagcaaggcctcatcttaacttgattgcaccttgcaaagaccctaattccaaagaaggtcatgcccatgggtactgggtattaggacttggacatatattcccggggacaccatcctatacataatactagctataactttttctatctttagaacgtcttccttgatcacctgtgccccatactgtcaactacagccccatttatctgccccctttaaagtaacctactccaagagctgtctacgcttcccttcttcctactgtctcttgagtctattcccgtcttgtttccatccctgcctcctagagcacttcatcttggcacgtcagccatcacctccatgtgttgcgaatccagaagtctgccccgtggtctttatcttgtccactcagcagcacgtgtcaaagctggtcactctctccttgatgttgtaacttgcctttgggatgcccgactgtcttccttatcttgcctctcactgttggttctcttgcagcgtttgtggctcttggctttcatttgttctttttcattctctgtcctgctctgcgtcccaggggccaattcctgcaaacacgttcccaggtgcctgtgccaatgagcttccggttgcttcaacaagcagagtgtccgggcagggagttgcaagacctggcagaggaggggaagccaggtctttcctggttctgggagcatctgtaccatggtggtacctctgccattgtccgagctccctgagtgggggaatgcggtgcgggctttttctgtgctttgttgaaaggaatgtaaaggaaggagagggctgaagaattgcatgtggtggtcagtgaggggggccacacactgggctccctccagatgtaaataagctgggtgtggggctttgggcttggaagtgttctagcccctgatgccttcagcagcaggctgacttggtgacctaagcagtaaatgagtccaaatagcaacatgccctgtctaaaatctgcaacaccacccctttttaaaaagaaatacctatgctgtaaattacacatcaacgaaaggaagtacttctcagtttgcctaaaaaggctaagtttgcggctcttaaccttttggtgggacctactcctttgagatgctgattatgtctccagaagaaacacacacccacacaaactgatgtggactctctgatgcttctcagaggcctgcgattccctttctagaaccctgatagtccccatgacgtcctgggctgcaaggagttcagcaagaggaccctgggtcatctggggtaggagatgttttatgtcgttagcattgatcatgtgatagtggatacatttccctaagtgcttatccaatcgcagtgtcattgaagactgttgaagcaaggctacctgggcagaaatggacaagatgtgggtgtgcagggtgcctgtgtacaatgcacagaaaatgggctggtgcaagtagaagctggagggaggggtgctccatggcgccccccttggtggaagagcctcttcatcatgcaacagttggcacggcagtgggctgtgaagagaggagctgaagcagtccgatatttctttcgtcttcttgccttcgaagattagaaatgcatctttgaaatactaaagatttgaaatgttgcctgtaatcccagctactgagggggctcaggagggagcatctcttgaggccaggagttcaagaccatcctgggcaacatagtaagacctgcatctctacaaaaagaaaaaatattagccgggcatggtggcgcatgcctgtagtcctagttacgcaggaagctaatacaggaagatcatgtgagctcaggagagtgaggctgtggtgaactatggtcgtgccactgcactccagcctgggtaacagtgagaccccatctctaaagaaacctggcagtgaggatatagaaaaaggtatgtgtaccccagtggaggtgcctatctcaactgttttgagagcaccttggcagaatttatcaaagccaatgtgcctacaatgtgctgtgtctacgcgcttttccttctaggactctactctgtagaaaaactggcacaagtgggcaaagatagagaaataggcacacagggacacttaaaaataatactagatgttacaaaaatcaagtgacatgcttattgtggaatacaatggtttttcaaagaaaggaaacagggttatttgaggttgcagaataatatgtaaagcttgaaacacagcaaaaaattgtgagatgtacgtaaatgttataatatgatatgataccattaaatgaatatccctaaaacaaattctagaaggaaacctatgaaatgcttaagggtgactgcttcttgggaatacgactgtggagggaatgaggagggcttctaccttttgcttcttaagtttctgttatatttgaatatttacaactaacatcaactaaaatgatatttttaatgatcttgttgcatctgacaaaatgatgcttttttaacaacaaaaatctttccgtttttgcattaagtgacttgtctaaggttcttttttttgtgtgtgctttccatttcagattctcgatgaattcaaaaaggattcgtccgtgttcatcctggggtgaggcagctcttgtgtgtcgttcggggcggctgtgccggacctcggtgcctggtgcccagccggcctccaggaggggatgcctgtgtgtgcaggcgctgacctccaaaggggcagggggcccctgctggggaattggccatcccatgcctgtggcgtggatagagatgagcagtagcaacaggaaggtgtggagcactgggaggatggtccagaaagttctgtagaaaagcctgtgtgcctcagggcctcctttccccgaatgtgcctcatgagatgtgacaggttaatagtttttttttttaattacaaaaactaatgttaatgatcaaataagtgaaaaattccttgttaaacaggtttaactgaattaaaatgagttcaggtgtataaactgcttcacatgatgcttggcacccatgaggggctgatagatagtaatattattactaaaaagtcagagttgcaggacttatcaggacattcactgtgcctcatgatttcccaagtggggaatttctgagatgttatgtgtttccccagcctatctgactgggagaaatgttggccctggagttaatggtctggggtacgttgatccagtctttatcggtgagcaacttttccctctgtcacttttgaaatcagaaactccaagactccaaagtataaataaaatgaatctaatttttatatagtatgtatattcgagacggagcctccctttgtcgcctaggctggagtgcactggcgcaatcttggctcactgcaacctccaccttccaggttcaagcgattctcctgcctcatcctccgaatagctgggactacaggcatccatcatgtccagctattgttttttttttttttgtatttttggtagagatggggtttcaccatgttggccagtctggtgttgaactcatgacctcaggtgatccacctgccttggcctcccgaagtgctgggattacaggcatgtgccactgtgcccagccataatttctatgtagtattttaatgaaaacttagtgttagactgtgaggctggtggggaaaggttagaattgtactcataatcaaagacaacagactcctggaccctgagtgtttagtaaagggagaaagctcagggcatgtttcatctcttacactatttgaaatagacctcttttccccaggctcctgcaagtgctcagggaaacatacccattaccctgggaagccccgtgtagcagaatgtactccccatccaacccgggggtggctcgtgctggcccagtgaggccctgtttttctggtggcctgctggccaaggcgggagtcctgcctttattcggagtgtagtgttccctagtgttccctacctgatacctaacctctgcttggtccagggaagtgtctttcacactgcagttaattttgccctgatggcctggagtctggtggggcctcatgtggctcccactccagagcactcaatgacccagggaactctggatcgtggcttctgaggaggcccttgggtctggctcctgtcctttctccaacaccagctctccctctacgggcgggtggtgtgtcgagccctgtctgggtattggataggcacactcacatccctgtgttccccacaccttttgctctgcaatccctccctctggcctgcgttccctcgctcctactcctctttctttcctcccctcccttctcttttttcctcgaggccgctgcttctctggtttccttgccaggtactctctgcacctccttcttgctcaccccacctcattcttgctcaccccacctcattctggctcaccccacctcgttctggctcatcccacctcactctctggagctcaagtaggtgccttttcctcaggaaagcccctctggtcctccaggtctgggtttggggccttctcagccattcccactcttcccctcccttcccaccctcatctcttgctacactgtatcccatatgcctggttcacctgtcttccccatggccacactcctggaggggctcctcagactctggggtgcaccagagctattttggagcagctaaatgtagacaccagggcctgccccttgagattccgatgtcagggtccctctgaatccttgtaggtgagggacattgtgtcactcacctgtgtcttcctgttggccaacctggtacctaacacagtgccagactaagtggggcgttctgggtggcaggctgccccattggctggcatctcctctcgactcctctgttgaatgtgtctgtctctaactgcaccccctttccccgaggataggaacactgacaggccggatgcctctgctgtttacctgcatgacttccagaggtttctcatacatgaacagcaggtgagagcacaaggtgtgtgggtgcctgagggagctggcgggatgctgctggggactagtctcacccttctgccgcctgtgctcacctggtcacctgtgctcacctggccacctgtgctcacctggccacctgtcttcatggaacgattgcagtctgccagatgccagagacttcagattgctgtctgatgccactgaaactctggatgagaagagcctcatgtcgggcctcttttgaaggcacacattgaggatgagaagactgagaagatggcagggcaggaggggtgagggcctgaggatggggctgccctcacctggctgggtgcaccttttctggccatcatctcaggtgtcactgcctgggaagccttccttgactgatgggaggatgggatcagattcatcaagcctgccaggtcccctgggagataaactagcacagctttccttaaacaggtgatgcctgggacagtctccctggacagggtttgcctgtgggctctgagcccagctatagactcaagggggggttgtgttgcgccttggttttccactgctgtgacgatgcccccagaggacactgggcagtgtccagagacgacatgggtgcgtgtcacagcgggaggctgctgccggcatctagcaggtcaacaccagggatgttcctaaatatcctacattgcacagggcagccccccctaccccccagcgaagaagtattcagggccgggtagggtggctcacgcctataatcccagcactttgggaggccgaggcgggcggatcacttgaagccaggagttcgagacctacctggccaacatggtgaaaccccatctctactaaaaatacaaaaattaggcaggcattgtggtgggtgcctgtaatcccagctacctgggaggctgaggcaggagaatggcttgaacctgggaggtagaggttgcagtgagccgagattgcgccactggactgcagcctgggcaacagagcaagactccgtctcagaaaacaaaaaacaaaaacacccccaccccaccaaaaaaaaaaaagtcaaagaagtattcagcaccaagtacctacagtgctgaggacaagaaactctgtgagagtgagatcaacttgaaatcatcttaccagctgcacagccaccgacaggtggtttaccctttttgtgccccagtttccccctctttaagtgggattgagagcatctacctctgagaattgtggggatcagagtcaattgtatggatctgtgtgtgtgtgtgtgtgtacatgtatgcatgtcttttcacatataaatctcaaatttttgtttatatcattggagttccatttacttttttcttttacttcatttgtttttttttaaatagagtttatattttagagtagttttagggttgcagcaaaaataagttcatttacttaaaaaacctcttgtcttgcagaacatttcaaacatacacaaaagcagacagacggtttaatgaaccaccacgtatcatcactcagattaaaaattacgagcattttgcaattttttttttgtttgagataaggtctcactcacccccttgcccaggctggagagcagtggcatggtaacagctcactgcagcctcgacctcctgggctcaaccgatcctcctgcctcagcctcccgaatagctgggactacaggtatgtgccaccatgcctgacaattttttttttttttttgagatagagtcttgctctgtcaccaggctggagtacaatggctctgtcccatgttcaagtgattctcctgcctcagcctcccaagtagctgggattgcaggcgtctgccacaacacctgtatttttgtatttttaatagagtcggggtttcacaatgttggtcagcctggtcttgaactcctggcctcaggtgatccacccgccttggcctcccaaagtgctgggattacaggtgtgagccaccacgcccagccccgactaattttgtatctttagtagaaacaggatttccccatgttgctcaggctgatctccaactcctgggctcaagtgactcacctgtctcagctccccaaattgctgggattacagatgtgaggcactgtgcccggcccactttgccagttttatttcatccacttctaactttacactcctgtatctccctacccttcccctttcttcatttctttgctgaagaattctaaagcaaaccccagactttgcgtcattttgtttgtaaatacttctgtatgtttctctcacagatagaacttttttttttaaaatatagccataacactcctcttacagcttgtgcaattaacagtaatttttaaatgccatccgatacccagcctgcatttggatttcattgatggaagagaaacttatgagtagagaagacatgttttgcacaaggccatccacactgagggctcaggaaagggtcgtagctaccctagtaggctgataaatggtgaatgaggatgttgatgcgtgttgtaatcatcatgccttcctagtgccggggttgaatgatgatgatcaaaagaaggcttatttgcccaacctgagactaagtttgagggaggaagtaaaatgaaggtaataagttaattttattgggcacagtcacgttaggtctgagctggtgctagagtgaggtagagagaaattcatgcacttttttcccttcattattttccttccactaaattattcagtttagtagggaacgattaaagttaaattggttaaattcttggggacaagtagcctcgcatcctagaattcaccacctggtagggagactggggcgtgtagatttaccccacctagtggtggttgactttattacgtgctttccccaaacggggccctttgctgggctgcccttagagatcagggatctggggccaggagaaagtgtaggaaatctctctctctgcatctggggagttaggacccgagcagccatgagcatccatgcgatgtttgttggtcacacagatgctcatatggaataatcactgcagcactttgtgtgcaaattagtatgccttttctagaaaacactttggctgtatgcaatgaaaagaaagctttacaactcgattctatatctggagtaaatagttgccctcccagacacttatcctaaggaaataatggcagcatttttaataggaatgaaaacttggaagtaatctaaatttctttagaggattggttaagtacgccatagtacagctctgggatggatgggtgatgggataggaagggggttaaaagtatgtttctagaatcagtgtttctgggtttagtctgaggctcatgactgggaccacttacttaatgactagaagcctctcctctgtttccccatttatataacatggagaataacctgtacctcctggggtggtggtaagttcaagatgagacaccgtgtggggccgagtatagagtcagtgctcagtgttgatggccatcgccatttatttttattttcatccttattctttgccattttcactattacaggtatctagtgcaataccctacaccaagtggatgcattttataacccctagaatattgacatttcagtcttctttaggtagaagatttctttctttgcagccagtccagggccaggttatattagctaagtacccatgccttttgataaatgcaaaaactttgtagggggaaggaaggagaatgcctccagcctctttgggacatcttggccaggcaaagttgttttttttttttttcttttgagatggagtctcgctctgtcacacaggctggagtacagtggcgcgatctctgctcaccgcaaactctgtctcctgggttcacgccattctcctgcctcagcctcccgagtacctgggactacaggcacccgccaccacgcccagctaattttttgtgtttttagtagagacggggtttcaccgtgttagccaggatggtctcgatctcctgacctcatgatccgcccacctcggcctcccaaagtgctaggattacaggcatgagccaccacgcccggcctagtattttaataaaatatcccacaatttgggtttcatgttctagtattcaaagattctgacacctctgtattcaaatgagcttgtagtttcccaccttcctagctgttttgggcccctgatccaggcatatttgcaagagtcaacagcagttcatttttgtcttgcacccatgcatgtcaccagcctgctggtcaccacctgatttgtgtctgttcttctatttttcattgtttcggacattgcatccagcccttcccatctaagcacacacacatctggtcgcatatttgcttctattagtcataaagataaagttgttagaatatttgaagtgaagaaagcattgatcaaagttgaatttacatgtcatatttcatccccttttcctatgaatatttgggatttcagggcatggagaggaaagcaacagttacttaatattatgcattctttttttaaagggtttctagaatgtctaggactgtgcagcagctgctttggaactggtcatgtatatttcagacgttatcagtgtttcagcagccctgtttgcctattcttttgaaaagagggcatatgattacattccatatcagtttcgttatttggagctgagactctgcagtttacaagctgtgtgagcttaggatcatgaggtattgttcctgggcctctgtttccttttctgtaaaatgacaatggcaataaatgacttgcggagttgtgtggactaagtgagatgaccataggaggaagaaagatgcttgtttgcacaagctgccacggtcagagtactttctttttttttgagacagagtttcactctgttgtccaggctggagtgcaatggtacaacctcggttcattgcaacctccgcctcttgggttcaagcaattctcttgcctcagcctcctgagtagctgggattacaggcacctgccaccacgccaagctgatttaaagaaaaaaaaaatgtttgtattttagtagagatggggtttcaccatgttggccaggctggtctcaaactcctgagctcaggcagtccacccgcctcggcctaccaaagtgggtctgagcactttctgtgcaccaggtgctgcattaggcacataacctaataagattttatacaatgcttcatacagtgtacatttcatacaatgcttcacagaaactgtgtggtagatactcttattcccacttcatggatggggaggcacagagacggtatgtaacttgcccaaggtcaactaggtggaatgagatgccaacccaggtaagtgacctggaaggctgatgtaactactatgcccccaggctgcttcatactaacaaacgtaaagagctatcatagggcaggagctggcaaaccatgacctatggaccaaatatagctgaccacttgtttttataaacaaaatattgttggaatacaaccatgcccatttgcctacggatcatctgtggctgcttttgcaacacaacagcggagttgagtggttgcgacagacaccgtatggctcagagagcccaaaatatttacctctggctctctgcagagaacatttgctgacccctggcagagggccatgtgcagaatgaggcctcaacatgtggtggtcgattgcaagtgaattcggaattggttgatgtttcagtcttcgattgcgactggatggaccctgggaaatgaagaattttatcagttctcactttgctgatctctcgttctctttgtcattttaaggagcattgggctcaggatctgaacaaagtccgtgagcggatgacaaagttcattgatgacaccatgcgtgaaactgctgagcctttcttgtttgtggatgaggtgagtaggctgggcttgttgtcgcttgggggtgactttttgattgatgtctgtgctttctgaggtttattttctgtttgtctttccttggagaactttgctgtatgatgttgcctcgactgactggttagctgggattgtttcttttcttttcttttcttttttctcccaggttctagattactgtaactgtaactgcccagtgggttcattttgcctgctgcctagacagaaccgattgatcaaggcaggggaattgcaatagggaaagagcttaactcacttagagccagctgaatgggagactggagttttattattactcaaatcatcctccctttcagaggctggagtttcgtttttttatgtttttgtttgtttgcttgtgtgtttgtttttgagatggagtctcagtctgtcacccagcctggagtgcagtggtgggatctcacctcactgcaacctccgcctcccaggttcaagtgattctcgtgcctcagcctcccgagtagctgggattataggcgctgtccaccatgtctggctaattttttttgtatttttagtagacagggtttcactatgttggccaggctggtgtcgacttcctgacccttgtgatcagcccgcctcagcttcccaaagtactgggattataggtgtgagccaccgcacctggcggaggctagggtttttttttaaagattgtttggcgggccagggaaagggtgctgctgattggttggagatgcaatcatatggttgtggaaaatagtgtgcttctgggtggggccacaggaccagtgggcggtccaggtagagccatgcgaacgcccgaaaagacgtctcaaaaggccaatcttaggttaaaccacagtgatgttatctgtaggagtaactgaggaagttgctaatcttgtaacctccagaaaaatggctggtaaccagttagtctccaccttagcagaatccaggctcctctcatcctcctaacctggtcttaccttagctttacaaaggcagtttattttgggggaagggctggtatttaaactataaactaaatgttttccaaagttagcttggcccaagcccaggaataattaagggcagtttggaggttaaaggcaagatagaggttggttagatcagatctgtttcactgtcataattttcttgttgttctgattttggaaaggcagtttcatagccctttcttactcttctctactgaccgtgttgcctgggtgggattattgattttgccactagagggcatctgccaccagggagagttgaaccattgcaagcacagaaacagaatgcgaaggtgtctgggtgcttgctggtcagaatggttgcctttgaccttgcatagggaaggaggggaggtggaactggggagcgactgacccatatgaggtcgttctcacgcagcagaaattaggcccagatcgctaaagcatttttttttaaggggccaggaattgtaacttgaaatttcctgccctttcaacattctgatatggataacactctgtttcttaagttgggtcgtgggttcacaaatattcatgctactattatgctttaaattgtatatatgaggccgggtgcagtggctcacgcctgtaatcccagcactttgggaggctgaggcgggtggatcgcttgaggttaggagtttgagaccagcctggccgacatggtaaaattctgtctctactaaaaatacaaaaattagcctggtgtggtggtgcacgcctgttatcctagctgcttgggaggttgaggcaggagaatcgcttcaacccaggaggtggaggttgcagtgagctgaaattgtgccactgcactccagcctgggcaacagagcatgactcagtgtgaaaaaacaaagaaagaaaaaccaacaacaatgtatatatggtaagcataaacccttgcagtagcaaatattttaggataaacattacaaaggaaaatattgtctaggtccatggaacaaatatgtcgctgcagcccattgcagcctgagccttcggtattgaaaacgtgggtaactgaggtctggagaccgcctgttgatttcccgcatcagagctgttcttcccccctggtgggcgcagaccagaaacaagcagacaccatcctgcccgtcaacgtgatgattcggtcttcgtgtttgactcttttagttcctcacgtacctgttttcacgagaaaacagcatctgggatgagaagtatgacgcggtggacatgcaggacatgaacaaccccctgtctcattactggatctcctcgtcacataacacgtgagtttcagatgagcctgtgatgggttgggcagcacagagcacgtgagggttgaggcaggggtccgatacgccgctccggtgagccctgttgtgaagcaggtggagggtgtagcaccgcattccttggactaaaatacacagaagcttctggaaggggctgggaacacacttccctttgtcagctggcattgtaataataatctcttttctgtggccctaaaaagctagtaaaaacaaaagtaacttagtttatgtaacttagtaactaaagtaacatagtaaacttagtttttcacgatttgggcatctcacagtagccacagcaaagcaattcagtgactcattgaattgacttatagggagtgtgtaccctgtgcctgctgggagctggggatgtggctgtgaaccggcagcagccatgtcctcatgtgctgggaggaagacctccattgaaagttaaccacagaataggacttgctgatgtggggagcaggtggtaaggcaaggagaagtgtttcagacagaggagcagcatgtgccaaggccctggggcaggaacaactgagaggagtctgctaaggctggagtgcagaatccaggagagcggtgtcaggaggggaggaaggcaggtcctgctggagcaggatcttgtaggtcaccgtgagagctgtcggggagaccctgacgacttttaaccagaagatgagatgctcacagggggctcttgggatggttactctgattgcaacagaaggaggatacaggatgttgcgctgatgttccagtatttagtctgtcttattgggtgaggggtgaagtccttgggtgatggcccccacagctgtgggtggggactttcctaagtgacattccagggggtcatctgggaaaaggctttttatggtgttatgctccaggcatttgggaaggtaaaatgtctttcagggggaaattgatttcacagttctctcttccccaccatgcccatcattttaagagtttgtgtttcagcatggtgaattctagaaaacctagaagacagttaagaaatacaaacttaaaaaaaaaacttttattttcagttcagaggtacatgtgcaggtttgttaaacgggtcaacttgtgtcatggaggtttgctgtgcagattattttgtcacccaggcattaagcctacttactacccattagttatttttcctgatcctgtccctcctaccaccctctgacagaacctagtgtgaggaacataaacttttttttttttttttttgagacagagtctcactctgttgcccaggctggagtgcattggtgcgatctcagctcacaacctccgctttcccggttcaacagattctcctgcctcagcctcccgagtagctgggactccgggcacgagccaccatgccctgttttgttttgttttgttttgtttttgtatttttagtagagacagaatttcactatgttggccaggctggtcttgaacacctgacctcgtgatctgcccgcctcagcctgccaaagtgctgggattacaggcatgagccatcgtgcttggcctcggaacacaaattttaaaaaagttggggtgaatcatgacaaggaggaaagtgcattaaagagtcattcttacggcagttttggtggatatggctcctagcatagccgattgcaccaacagttgttgaatatctgttctgtgcctggcctcaagccttgatatcaaaagaagtgcccatctttgtttagaccgaggacccagagagcggccatggggccttgttaattcatcttctgcagctttttttgcttctgacgtgctttgaccaacttctcctcaaaagaacacgtcctctccacgcttgcattgcccaggtggtcagcagtcacttcctgcgattgtggcctgacttcagagctcatgcccagtgtgaccgtgggattgtgtatttctgtcctaggccttagctttgagtctttctacatggaagaactcagagctttggcggctcgggcggagaagttcccccacaacaccctgaggtgcaggcttgccccccaacccctgtggctgccactctcacacggccacctgccttctctcctgcaggtaccttacaggtgaccagctgcggagcgagtcgtccccagaagcttacatccgctgcctgcgcatgggctgtcgctgcattgaacgtgagtagctccttcttggtggaggtcaggctcgcagcaaattgaggataaccatgtggttgctccatgttttctttcgaattgtaaaaaggttttaatggacacataataactgtgcatatttatggagttagagtgtgatgtttctttgttttcttttttctttctttttttttttttttttgagacggagtccctgtcatctgtatctcctcagcttcctcctgggctggtattagaggaaggcaaacagacacccgctgtgttttggcagctgggtcctaggtgtgcacaggtaccgcgtatcacctggattggggggtctctgagcaaatgtgaaaagaatggtcagggctggatatggtggctcatgcctgtaatcccagcacttcaggaggctgaagtgggaggattgtatgaggccaagagtttgagaccagcctgggcgacatggtgagatcgtatcattacgaaaagtaaaaaaattagctgtgtgtagtggcatgcgcctgtggtcccaacaacttgggaggctgaggtgggaggatcgcttgagcccaggaggttgaggctgtggtgagctgtgattgtgccactgcactctagcctgggcaacagagcgagactctgtgtctaaactgaaaagaaaagaagggtcaggtggcatctctgcctgggcagatggcagacgccttatttccctccttccttctcatagcctctctggctattttccttccggcctctctctcaccaaaggctcatgggtgcatttggctgagaaaaggcaacaaccagcttgtcgtggtgtctcatgcctgtaatcccagcactgtgagaggtcgaggtgggcggatcacttgagatcaggagcttgagatcagtctggccaacatggcgaaaccctttctctactaaaaatacagaaattagccaggcgtggtggtgcacatctgtaatcccagctgcttgggaggccgaggcacaggaatcacttgagcctgggaggcagaggttgcagtaagctgagatcgcgccgctgcacgccagcctgggcaacagagggagactttgtctcaaaaaaataaaaataaaaaataaataaataaaataaaaaaggcatcaactactgacttaggctccagtgttaccaaaacgactcatcatggaagcaacgttttgtagcagttactctatagactttcttcccgtttatgatttttctcctccctcaggaaaaaacaaatgtttaaaagtaaagcttgaagcagtcagctcctgtgccctccaggggtccaaaagattggggatgttcatcttccacatgacccatttctgtttgaaaatattactgtgaacctttacaaataaatttctcattgctctgtatcatttccacgggcagaaaaggcagtcaaggttttcaacaggtaaagtcagaaaataaaacacgtggtaaaatcttctttaaaaagaagcattgaggttgggcgtggtggctcacgcctgtaatctcagcactttgggaagctgaggtggatggatcatgaggtcaggagattgagaccaccctggccaacatggtgcaaccctgtctctactaaaatacaaaaaaattagccgagcgtgatggtacgcgcctgtagtcccagttactcaggaggctgaggcaggggaattgcttcaacccgggaggcggagattgcaatgggccgagattgtgccactgcactccagcctgggcaacagagcgagactctgtcttaaaaaaaaaaaaaatgaaaaaaaaagcagcattgaaactagcttgtcttggacagctgcacttgcattatgtaagcgcacagggaaccctgcggatacagggaaagccatgtcctcgtgttggcagccgaatggagggagtgtgggtgtccttgtctagtaactgaactggtgtgtgggccgggggctgacctcggggctgtcagtgaacacacgtggtattgaggctgccgcgtttctccctgtagtggactgctgggacgggcccgatgggaagccggtcatctaccatggctggacgcggactaccaagatcaagtttgacgacgtcgtgcaggccatcaaagaccacgcctttgttacctcgaggtcagttggctgatttctgggtggtgtgacttaaaggggaaggcagctagggttggatagacagatggacagacaggcaaacacacacagacacctccctccaaatgcgggaaggcctgggccccatcttggccaaagccactgccatcaagttctcacccgagtgttggcaccccctgcaggccgagagtgcaagttgctcccgggctctagagccccgaggaggctctggctggggaaccctgtggctgctcagtgcccaccccacctcctcattctgtctggcccccactttcagaacccccgaaagagagggaaaggctgggcgcagtggctcacgcctgtaatcccggcactttgggaggctgaggtgtgatcactgaggtcaggagttcgagaagagcctgggcaacatggtgaaaccccttctctaccaaaacacacacacacacacacacacacacacacacacacacacacacacacacacacacacacaaatcatctgggtgtagtggcatgtgcctgtagtcccagttacttgggaagctgaggtgggaggattgcttgaacctggcaggcagaggttacagtgaggtcacattgcgccactgcactgcagcctgggcaacagagcgagaccctgtctcaaaggaaaaaaacccaaaaaaacaaaaaccaaaaaaaaagtgaggcaaggaaagtaaaattccccttctgtcctaattccctcttttgtgcccagttctcacccccaccaaacctgtttctacaggcggaatccaagcagccagtaatggtggtggtgtgttttttgaatacccacctggggccaggctctgtgctaggttctttgtacaggtgatcatattgattctttgccacaaagtgagtatggtcatccccatttaacagatgagtaaattgagacaaggaggggttaaatgggtgagaacatttaggttcatttcaagggtttctgacctcaggtgtaatccttttctgtcccaccagaagatcttggtctgggctggaggtcaacgaaattgttctataaagagccagatacaaatgtttcaggctttatgggccctgtggtctctgttgcaactattcagccctgttgctgaagtgcaaagcagccatgggcaagaggtaaacacatgagtctggctgtgttccagttaaaacttgaattacacattacaaaaatagatggcaggccagatttggggcagaggccatcatatgccgactcctggtttgggttccttgttatttctgagagctggcaagaggccttctataggctcattggaatgatagttgtctttttatactttctggggtagaatagcagttacgagtatgggttctgagtccttctcgctgagtttgaatccagctgttgagtactagtttgggcaaagcacttaccatcctatgcttcaatttccatgttaaaaaatagaggtgataactgtgtgcacctcacagggcggttgtgatgattaaatgagatgccattacagcaagtgcttaaccctgcacctggcatagagtaactgttgagtcaataagatcgattattttttctctttttttcttttcttttcttttctttttttttttttttgagatggagtctccctctgtcgcccaggctagagtgcaatggcaggatctcggctcactgcaacctccacctcctgagttcgagcaattcccctgtctcagcctcccgagtagctgggattataggcatccaccatcatgcccggctaatttgtgtattttggtagagatagggtttcactatgttggccaggttggtcttgaactcatgacctcaggtgatcctcccgcctcaacctcccaaagtgtggggattatgggcatgagccaccgtgcccaacccgattggttatttttattgcatttactgcagatgtcccttgagctgggtggaggtgttgctgtgagacaatgaaattatggacgtcttttcgcacttggtgaaaacctttcaatgaaggcatatgatttctccatcgcagcattctcccctgtggggtcctagcccttctaagtgccaacctccatcaggcagatggaaggagctggtattaacagacactgtgcagtggcagcttacactctgctttgagagtttgctttcatttgcaggacataggtgcttatggttgtgagctgacagtcattcatcgaacattatctcattcatgactagaggaagttttttctggttaaaatagggctggaatcatctaacacctatagggctagaactctgtaatcaaacattaatgcattaatgttttggcagcaaaagccatccttattggtattaagagggatttaagaaaatgattgcaagcagcgttcattcgaatggttcagattttgctgtcagttacattttgataccaacttactaggtagcctttgttgtaaaagctttttagctgttatgttctagtaagggtgtgtggatcaggatcggggagtgagctgggtccacgcttcccaggagtgatgaggctatgatttacttgagctggaacatggttaaggattttatttttatcatcgtcactttattttcacatttgccttcatttctattgagtgacgtgatttcctatttatggaagtgacatagctgcctttagaataattttgtttcatagtaaatgccatgcacaagcctcagatggattcttggtgggaaaaactccatctatacagtatatttcttggataactggggaaatttgagtatgtctaatgatcagtatgtctaatgatcattatttaaagatagtttcctgaggtgatatggtgtggtgatgtcaggggatgttcttaagagatacctgtgggggatgtctgcgccttatttcagatggttcaggaggaaacgtaaatatgtgtataaatgaaatacaaatataggctgggcacagtggctcacgcctgtaatcccagcactttcggaggctgaggcgggtggatcaactgaattcaggagtttgagaccagcagcctggccaacatggtgaaaccctatctttagtaaaaatacaaaaaattaactgggcatgctggcagatacctgtaatctcagctactcaggaggctgaggcaggagaattgcttgaacttgggaggcggaggttgcaatgagctgaggtcacgccattgcactccatcccgggcaatgagtgaaactccatttccaaaagaaaaataaataaataaaataaaataaataaatacataaataaatgacttttctcctgcctcaggaggagtatgtgtgtatatatatatatatatatacacacacacacacataaatatatatgtgtgtatatatacgtatatatgtatatacatgtactaatgatatgtgaatttatacatacacgttcacatgatatagaaggatacaggtgatccttattggtggattctacttgctaaaattgacttgtaaccccaaatcaaatctcaaagcactctgaggtcattctgagacacgcacaaagtgtgggaaatgagactcatgcgatgcacacgtgttcagctgagggtgagcaaagcagcgctccccttcctggtctacagcgtgaaagcttcaacaagtgtcctcaccatctgttgactgccatgtttttcctgtttttgagctttttcttggtgatcttgctgttcaaatggcccgaagcacagtggtgagggctgcctggtgttcctgagcaggagaaggctgtgatgtgcccgatggagaaaacacctgtgtcagatacgcttggttcaggcacgaattacagtgatgctggctgtgagcccagtgtcagtcaataatatataccaaatcaggtgtctttaaacagaaacacacataaaacaacgtcagatattgattcattgaggaaaatgttgtgaccacacgctcaaaaggccctgatcctgtatttccccttaggagcaatggctcaggtatttgccaatcagtgttggtggtgactttatgaaccataaccccaatagataagaaaaatcaactacagatacacacaaatgatctataaatacacagacaccttatagaaatatacatatatacacatacaaataataaatgtatgcatgcacacatgcaaattacatatgtgtgcatatgaatgagaatatataaaaccaatatactttataaatagaggaagtaataaacatactaaagtaggtggatgcacacgtggaacagcgtccctgttggtgaccctgggtgaagcacacatgggtgcttattgtgctgtctgttcatcttttctgtaggtttgaacttgaaaaaaagattagagacttttttctgtaagtttaaagatatgaatagatggaaaaaaatacagagaaaaggtgcattctggggtatggggaagctcctgaatcagatcgcagctgttctgagtcccaagacttgtgccttcacacccaggatgaggtcctctccttctgggagggcagatgtgggggttgtgccccccgagcagcgcccggtttctgtcgtcccagggagctgccctggcccctctgtggggcagatgcagaggtgtgtgctccccctgccgagctgcccaccctcttctgcctgcagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaaggtaggcaccccgggtgctgctgttggctgtccagggagcccagtggctcggttccccggctctgggtcccgttcaccaagttctatgtcctactgggcctgctccaggtcccactgcacaggctcaaatctgctctccttactaacactgtgaccttaggcaaagtcattaacctttgggagcctctgttgtcaccagtctctgggggagataatactggaactcatctggctagcttgctgggagcatgatgtgagggaaggcgtgcagaatgcgtgcaactgcgcctgtcatgtggttggtgctacgttaagtgctaacctgttatagttcatttgttcattggtgaaccttccccatcctctctcggagacagccccatgcgaggtgctggaggtgtccagcgacctgggtgctgttcctgtgattgcagcttccagttgtgtgggaggcgggcagttgctagaaaaggctgagtgcagcaatagagctgatgttcccagcactgcaggggagatgggtgattatatctgtgcctagggatgccatggtaacatttggatttttgaattattaggataaagagaccatatatgccgtggcttaaagcacagaagagtttatttcttccccatgcgagggagaatgttctgtgagttttgagctctagcccacaaggtgactcagggacccggggcccccgcattctgctctagcatctctcagggcagcagttttcaactggggtttcacagacccccgaagaatccacggttagaatcagaggggcacgtgaacttcaacagaaaaaaaattacatctttatttgtttaacctgtacataaaacttaatacttccttccattgtgaacattggcagcaagccacttgcgggctctgtcaccagcagaagtcatgagtgttttcatatcccgtttacagttattgcaaatatttcaaaataatgttgtgctcgtcatcactttggaattatggaggttattaggtctgcctctagatcttatttaagatgttaatgaagaaacccatcttttagtgtattgcaaatatttatttaatatcttaatcatgtttcaatataattgagtttcctttgtaattttatgcattattattctgagaaaagggtctgtagctttccccagattttgaaggagctcattacacaaaaacggtgaagggactttgctttgtccttgtttatgtggtggacgcttggtctcaggcacatccgagttccagctcagagcacgggaagtccaagggtgtccagggcaaatggtttctggtaagcaagtcagctgtcccgtccttttctctactgttctgtgcatgagagcttagtcacgttacctgcaaggactgtggaatctgaagtccctagcggggcagcctttcatggaaggagcgagtgtgaattttgttgacattccacgagctcatggggaaggacaaacagctgtttcctaggtatttcagtctgttcctgcagctatcacaaaataccctaagctgggtgggttataaacaacaggaactgatttctcacggttctggaggctggaagttcaaggtcagggtgctggtatgagagtcctcttccaagttgtaggctgccgacttctagttgtgtcctcacatggtggaaagggtgaggcagctctctgggacctcttttatttttaaatatttatttatttataaataaccatctgggacatggagatatctttggcctcttttataagggcaccattcccattgttgagagctctaccctcattcccattcactggagctctactctcattcccacttatgagagctctaccctcattcccattcataaaagctctaccctcattcccgttcatgaggactctaccctcatgacctaatcaccttctgtgttacccattctcacactgctcataaagacatacccaagactgggtaatttataaaggaaagaggtttaatggactcacagttccatatggctggggaggcctcacaatcatgtcagaaggcaaaggaggagcaaagtcacatcttacatggtggcaggcaagagagcttgttcagggaaactcccatttataaaaccagatctcatgagatgtgttcactatcacaagaacagcacgtgaaaggcccgcccccatgattcaattacctcccactgggttcctcctatgacacgtgggaattataggagctgcaattcaaggtgagatttgggtggggacacagccaaaccatattaccttccaaagctaccatctccaaataccattacattggggattaggtttcaacatataaattttgggaggacacagacattcagaccatagcagtaggcagagaagggggatgtccttccaggttgggacaataggacacacaagggtgtggtggtgtcaacacgtggcatgtaccctatattatcactgggccaccaagatacattggacacaatccttatgttccaggaagtcgtggtttggtagggagacaaacccgtcaacagagaaacaccaaacagtgcaaggagctttggccaagcacaaccagaggaggggatgttggtgcccccatgggtaagagcatcagtgcacggggagtgtttggccaagactgtgacccttaaggtacagatgtttgcctaagcgggagatcagctgtcattgtcttagtcttgcagatgagaagtgtgaggcctggagaagtgcagccacctggctggggtcacaagttaacaaaatagctgcagcactgtttgcacccaggcagttgtttcggagatgccaagggatgcttccagcacggtgaaggcaggataaggggtggagggagctcggccatggagggtccatggcttctcaggcacctagttggtgagtcttcggggcagcctggttgcatgtgctcttccctgttcccagctcattccttctgtttccattaggatggcttgctgcctgttcccagggagttttcagctcttgttctaagatgcaaagtactgaaggccccttttagagcaccctctgccccacacctgatacgctgtggcccacttctttctatttcaagaaatgaggtggaaatagcgttggccacacggtcactttgtaccatgcacttggctaggcgtggtcatatgtatcttcttattcagtcttgtcaagacactgcaggacgaataacctcagcccttgcccactttacagatgtggacattgagattcagaggttaaatagctcagccagggtcacacatttagtatttgctgaggaaattattcaaggccaaggtggtctgccctcagagcctgttttcccatgcctgtatcatgctgccattcacaagggacactgaggtcctgcttcactgttgacacttatctttcacgttctttgacttacgggatcccacaggggctgccacgtcccgattttacgagacagattactgagactctgatgatgactcagccaaggtcacatggccagtaaggtaataggccctgaattcaaatctggatctgaccccctatcctgagctccttcaccaggttacatgaccctcaacttacagacgcttgcctgcgtgggagtccaggtgtcatcactgtcttaatcttgcagatgagaagcctgaggctcagagaagtgcagccacttgcccggggtcacacagctggtagaatagctgcagtgctgtttgcaccccggtcgccttagtctaatccccattgggtcccccgccaccctgcccagcctgttccctctggactgcggcctgcctttccctctgtgtgctagagaaggctgggcacaggtggtgttgttgtttattcaccgagtatcaacagagcacttactgtctgctaagtgctcttctagcacaggagactcaacaggaagcaaaacaacatccctgccctcatggggtttatattctagcagtgaggacagaagacaaacacatggtgtgtgtagggctagacaagtgagaggaataaagcaggcttggggctagagagtggcaggataggaaggggagtgtgggctatttttacttatttattttttactgggacagagtctcactctgttgcccaggctggagtgcagtggtgcagtctcagctcactgcaacctccacttcccaggttcaagcaatcttactgtctcagcctcctgagtagctgggattacaggcgcgtgccaccatgcccggctaatttttttatttttgtagatacagggttttgccatgttggccaggctggtctagaactcctgagctcaagtgatctgtctgcttcagcctcccaaagtgctgggcttataggtgtgagccactgcgcctgaccagtatgggcaatttttagatgaagctgtaaggaaagctcctcctcctcgttcagggtaacctggagggcagagctgaacagactaagagggaagccaggcagcaagaacaggcagtgcaaaggccctgcctgggaagaggcagatgaaggctgctggctcaaaggcctaaacttgggtctccatggagacagcctatgtatatgttttcccctcagcataagaagctgggcccccgaggcgatgtggatgtcaacatggaggacaagaaggacgaacacaagcaacagggggagctgtacatgtgggattccattgaccaggtgggccttggtcccttcccgtagccactgcggccacgccccttgcagctgcttcttggagccctgctgggagctctgagaatacgcctgtcttgttcccatttttagtcaagtgagtttttgccatgtgaatttaccttccttcttaaactttatttatttatgttgtgggacagggtctcactctgtcgcccaggctggagtgtagtggtgtgattgcggctcactgcagccttgacctcccaggctcaagtgatcctcccacctcaacctccctgagtctctgggaccacacgtgcgcaccaccatgcctggctaattttttgtatttttgcagagatgggatttagtcgtgttgcccagggtgatttcaaactcctgggctcaaacagtcctcccaccttggcctctcaaagtgctgagattataggcgtaagcttctaagcctggccaactttattttccttttgcatttttaatgttttattttgaaataattttagattaaatatatttacacacacaaatagtatgggatattcccatctacccttaccaagcttctccaaatattattaataacatcctacataaccatagtataattagcgcaatcaggaaattaacattggtacaatactaataactagtttatagatggtatttcattgttgccactgtgttcactcaggctattttcctgtttcaggatccagtacccggtgctgccgtgcatttaggttgtcctgactccttcgtgtcctccaactgggggtcgttccaccagaaaccttatttttcagactttaatgctgcctctatccctttacctaatgtgtatatccattttgagtatatttttacatgtccgttcttatatcctagatataacatacatatcaaaggcaatatttatttattacttatttatttattttagatagtcttgctccattgccctggctggagtgtggtggtacgatcttagctcaccacagactccacctcccggttgaagtgattcttgtgcctcatcttcccaagtaactgggaccacagatgtgcaccaccatgccctgctaatttttgtagccttagtagagatagtgtttcgccatgttggccaggctggtcttgaactcctgatctcaagtggtctgcccgccttggcctcccgaagtgctaggattactggcgtgggccactgtacccagccaaaaatggcaatatttaagtaaagaattaagttgggccaggcgcgatggctcatgcctataatcctagcaccttgggaggccgaggaaggcagattacgaggtcaggagatcgagaccatcctggctaacatggcgaatccccgtctctattaaaactacaaaaataagttgggcatggtggcacgtgcctgtagtcccagctactcaggaggctgaggcaggagaattacttgaacccgggaggcggaggtttcagtgagctgagattgagccactgcactccagcctggtgagagagacagactctgtctcaaaaaaaaaaaaaaaaaaacagtgcagcacaccaacatggcacatgtatacatatgtaagaaacctgcacagtgtacacatgtaccctagaacttaaagtataataaaaaaatacaaataaaaacgttattaaaaaaaagagtttctgcataccctgcacccagcctcctctcacattaacgtcatgcatgacaataaaacagtgaccaaagctaagaacttaaccctggtactttacaataaaaccagagactaaatttcatcgggggaaaaaaaaaagaagtcattaagccacaaataaatattgaacgtaaggtctccagacaaactggctgggaaatcctgaaagttttaaaaggtagatggaatagaaaagaaaatgatgaggagttgtacctaccttagactcatggatctaaaaagtccaaaaagaagctcaaataccaaaagaagctcaaaatgcatcgatattttaaaaaagaaatgccttgtaaggaattgaattcagagaattcgccataaatgtctatgaaactgggaaaagcacatccatagtagatgctggggtgacgccctgcagggctcctgggctccacagttgatgaggtagaggacttggggggcactaataccagtttcactttctagaaatggactcggcactactgcgccattgccgatgccaagctgtccttcagtgatgacattgaacagactatggaggaggaagtgccccaggtagggggacaccctagccacatagggaggaggtccccaggaaccccgaggaccagccagtccccgggacctccttcccatgtggcttctctggccggctggcaaggggatgctccgctgaagaagctgttgatactctgggtaccatgtcctggctggcttgtctctgattggctggctgccccaggtgctttaaccagtgaggttcaagatgctttcctgctctctaaagtgcctgattggccttagatggaggccggtgctctggcttggtcccatgctttcctgttgccctctcctccagctgtggtcatctttcccgctgtttatttctgcagcccccagggcctcatggctctcagacttcccatagaacagaatggagggctttgctgggaaccgttcactgcatgtctcaggatgccaggaggccaccataaatgagggctctcaggagtgggaggcaggcagaggagggtagcaggtgctgttttcccataccccttcgggtggggaccagctgaggctggcctctctatgttatctggtaccctgggtcagggtgagacagaaggacctgtctagtgatgctggggtttggtccaaggctttcagaaacccctcctctctttgcggcccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggtaatgcccccgacccagggaacgcctaccttcttctccatgccaaccgatgaggcagggtggcgagtggttctagctcaggcaggaattgggcaggctgggacctgaatcccaggcttcatttgtctagctcttctaggccgggacaagggtgaggtgggtatgactcacttcggcactgtaacccagattaatgagatttcagggcaatcttttaaaaaatcaaaagtaatgcaaaaaagtctgtgatgaacaaaatatgaacattttaaacaaagacaagatctgaccctactcttagatgatgtggtctcactcactttccccgatcccagccctggagtgggtcatgtggctctggatgattcagccaaccttctagcatctctgtctcctccataaaacgaggactctagggctgtccttttgaagccgtcataggctgtgatgagcttgtgcattcattcatccacccacttatccatgtctcagtgcattaaaagatacttcttgagggcgtgccctgtgctagacacagtacttatgccagacagacaatgtctttgtcctcctggacactagcgtcttttgaaggagatgggcaatgaaaaagcagtcactcaaatgatttgcaagtatagttgtgatgagtgcaatgaaacaaggcaacataaagggacatccctccctttattgggggggtttaatgtgagttggggggatttgtgaaagtctgtgaggaaggctctgatgccctgacgtggggaatggttaggaaaaccttcctgaaagaagatgagacctgaaagagggaaattataattctgtcacttaaaaaaaaattgtgatagggtcttgctctgttgcctaggctgtagtacaatggagcagtctcagtcactgcagcctcaaactcctgggctcaagcaaccctcctatctcagccatttaagtagctgggactacaggcacatgccacgacacctgaataacttttaaattttttgtagagctggagtctcactacgttgcccaggctggttttgaactcagctcaagcaatcctctggcttcggcctcctgaagtgctaggattacagctgtaagccattgcacctggctgaaaattagaatactaataacacgcaaataatcctggacacctaaatgatgcttaccatgtgctgggcagtattcgagacaccttgtgtgtgtggtctcgtttactcttcaggatgcctctttgaggtggatactgttatcattcctgtcagaccgctggggtagtaatacagtgtggctcagacagcacgggtgacctgctccaggacacttggttcatatgtggcagagctgggatttgaatccaggcatcctggctctagagaagcagttatatatataaaagggggatggggtggggtggggtgggggaagtaggtagaatgttctggaatccaggctgagggtctagcctatactaaggccctgcatctggttttgttgttgttgttgttgagatggagtctcgctctgtcgcccaggctggagtgcagtggcgtgatctcggctcactgcaaccttcgtctcccaggtacaagtgattctcttgcctcagcctcccaagtagctgggattacaggcatgcaccaccatgcccagctaatttttgtatttttagtagagacgagatttcactgtattggccaggctggtctggaactcctaatctcaggtgatccacccgtctcggcctcccaaagtgctgggattacaggcatgagccactgcgcccagcctcctgtgtctgttctaggagcagagggaaggttgtgtggccacatgtaatgtccccgcctctgaggccctggctgccgcaatggcctggcctgcgttctcccagcactgatggcgtcctctccccgcaggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtacgtgtctgagggtggagcaggaggcaggcggtggtcgggttagctccaccaggcagagaagctggcctggtggttcagccgggccagtcccccaggacaccctctccccagcccaccggcatctcaaaattgccgaggtggccagtttccaaattcctggcaccatgacctgtgtccttttctcttttctttctttcctccccttttctcttttccctttcttctactttgtcttcatagccccgagactttgggctttgattttcagagggtcattttggcctggggatattctcttacctttcagagctccttcctgtttgttctgaaaatgaacaaggaaacaatgattataagagtctcccgctgattttttttatctagtgaaatgagtatcaaggtaggtcttgcgaagggtcaacaaattctgggaataaagaaaaaacaatttttaggcagaaagctgcaaaaatgtccatttccgaggaggccgtattacttatagcaactttttttttcactttttctgtcacattttcctatggattgcctcttaaaacttgctatttcttatcttaagaaataacccgaaaacaacccaaaaccttgtgaaactcctgctgtgatctccgtcttcgattttctgagacacgtggcaataactgtgcctccctgggagcctggcttttcaggtttgggctgcttgggtggatgaagatgaatcaattttttgagacaaggtgttgctctgttgcccaggctggagtgcagtggaacaatcacgtctcgcagcagcctcgagctcctgggctcaagtgatcctcccacctcagcctcctatctgggactgcaggtgtgtgccactgtgcccagctaattaattaattaattaattaattaattttgagaccgggtctcgctctgtctcccaggctggagtgcaatggcacgatctcagctcactgcaacctctgcctcccaggttcaagagattcttgtgcctcagcctcctgagtagctggtattataggcgcacgccactgggcctggctaatttttgtatttcctttttttttttttttttttttttttgggacagagtcacattctgttgcctaggctagagtgcagtggcatgatctcggctcactgcaacctttgcctcctgggttcaagtgattctcctgcctcagcctcctgagtagctgggactacaggcgcctgccaccatgcctggctaattttttgtatttttagtagagacagggtttcaccgtgttagccaggatgatctcgatctcctgacctcatgatccacccgcctcaacctcccaaagtgctgggattacaggcgtgagccaccacgcctggcccaatttttgtatttttagtagagacagagtttcgccatgttggtcaggctggtcttgaactcctggcttctcgcgatccacctgccttggcctcccaaagtgctgggattacaggcgtgagccactgtgcccaggctattttattttttatagagatgggggtctcattgtgttggccaggctggtctcaaactcctgaccccaagtgatcctcctgcctcagcctcccaaagtgctgggatttcaggtgtgaaccactgtgctcggcccaatgtattattttgggcttgaaacagacccctggggtcttccactattcttttcacaaattctctttgctgaggtgcctttgtctggggaagcccactgtgtgatttccatggtcgtttccagggccaggttccaggtgtcactggtgccattatcttgtcctctgcgggtggcccactgacagcctggagaccgctcacctggtcgttttccctggccctgtgccgcaggtggtactatgacagcctgagccgcggagaggcagaggacatgctgatgaggattccccgggacggggccttcctgatccggaagcgagaggggagcgactcctatgccatcaccttcaggtgggtgcgagggtgggaggcacatgctctacagaggggcttggcaaggacagatgcggagagacaagggggaacttcaggtggaggctcacctgcagtgccctgcccccccagcatcagcgacaacaacaaccaccacagcaaaagccgctgcgagaatgtgcgctcctgcgtgccaggcacagtctgcgttctccagggcaggatgttctgtagtaactcactttggcttccagtaactctgtggggttgacatgaccatgatccgtgtttctcagaggaggaaactgaggcacagcaagattaagtaacttgctgaagcatgcagccactaagtggtggggctgggattcgagcccagacagcccaggcagcccaggcctgtgatgatatagatctggtttcctcccaactgcagctgctgcccaaccacctctaggcctgtggttctctaatgttaccccaaaacgccagattctcccacttccactaatgacaaggagccgaggagtgactcagactccgtgtagcctactgtccctccatctccccagccccagggtttccctgcatgttcttacggtggtaacagtctgctatatgttgagttcctaaccgtgttctagacactggactgccttcaaggcctcatctgattgaatcctttgctacagcctgtgagaggtaggtctagttattgcaagggaggaaacaggaccagagaggttaagtgacctgcctggagtcacacagcctcatagtcaactgagtttgaggttcagatgcaggcctgtccgtctccaaagcctaagctcttcactccagagtctctagccagaggcctgggggccaaatctccagccagaggcctgtgggcgtcttttgtacactgatgtgaaaaactgagaaatttcactgaaaaactcagattgcttcttgtgaaaaatgggaggcagtggatgctctgggcctgtgtttccacatgggcgcggtggtgctggctgcatggcagctactgtggggtgtgtggtttgcccctgtccactcctctccccattccctctgccctgatcccatcccctggtgaccctgccaggctgccccctgggcgtttggatttcccttcctccttgcctgcaccactatgcctgagccacctccctggggaccgtggtgacggtcattatcactatagtttactgaggacctactgtgtactggctccagccagagagcagcctcccaccagcatggcttttctgtactctctgttcccaagagggtgacctgggcttctcagcattggtgcctctgccctttgctctttcccctaagcctcttagtggtacctcctcagcctggatggggaggaggtgtgttcagtccgctgcacacggattgaaaacctgctgtgtgccaggccccaggtggggtgttggcactcccactgtgctgtcatcctgtgcaaatgatggcaactaaacccaactggctgaaactgaggtgcccaagcggtgagacagctctgacacaaccggatcggggcctcacctgatgatggtcaggatgccacctgtatgtgcatgctggcgttactctccatcagcttctgtctcaggtggctgtaccttgggctgccaggacagtgtccggcagaaaggatggccccctccctgagccaggtggcatgattctgacaggccatctggggatggggttggggtcacttcaatgggaccgcgtgaatgaagaggttgggtgggtcctcaggttgattgcctgacttacatacacgccccattcagtttgtgagcttgtcttccccatgagattggaggtgtcttgagaatggaagtttttattttttagaagttaatagatgtttggtgagcacctactgtgtgccgggccctgtgctgggctccagagatgcaggagtgataaaaacagcccagtccttgctctctcaggctaatggtctggcagggatgagagacatcgccttactccaagtgtttcttgcttttgacctgttcctgcttatgtaacattggctgggatgtagttggtggttggtgaatgctggctcagtgaatcaatcagcaaggatggccgctccccacctcaccccatggcccactgtcagggaagctcagtccacacagtgtttctcaaagagttggggtgtgaggactgatcctgttgtatttggatgttgaacttccctggtctctacccactgcatgtctgtctgggaccctaagtcattgtaacaatcaaaaataacatccctgccccaggacacacactttttcaaaccctctctggtcagggtatggggtgaagcgtcactgtccttcactgagaagcactgaggaggtttgagcacataaggaaatcagtgtagtattttgtgatgagtgctacaaagggattggtcaggcagggtggtggagggtgagtagctctccagggaaacggatggggaatttggaccaggcagtaggggaacacaggtctgcagcaacttctccttgccctctacatatttgtaaagtgcctctcctgtgccaggcactgttctgggctctggggatgtgtaatgaacttctggatagatttccccagtagaggagaaacacctgctttcaaatccacaaaggaagtgttgagttgttgcccggctgtgattggtggaaggcatctcttgggcagtgaagctgagacctcaggctgtggccgtggcatccacgctccaggaggatggaagatgcaactcgtattccagacctgttcccatctccccttctgattctcttttctcccagggaagttagttgtgggttgatttcatttatgttttccaaaccattcacttactgagtcctgcctgagtgccagacactgtgccgacagcttaccctgaataagctaatagacgatgatcctaatgctccccatgcgacgggttgtggatccccgatgctgtggatcgggaagctgaggcttaggggtcccctgtggaaggagccggaacctgaccttggctctgtacctcggcaccccagagcccccctgcctgccctgaggagctcttataaaaagttttaaaattaatttttaattacatgaatattgcaggaggatattctctctataaaaaattaagacattacagtgaaggctaaagccccctgtggtccttctaatctcagtagagaggtcctggtagaaagcacagttttctagctggtgtgtccatccagacatttaaaaaatatgtacatatttatacatgtctgtatctatggaaaatatatggtgccattttgtgtctgggtattttcattctatttttagaaaatacaaatgggaacattctgcagcttttctactcagcagtgtttcttttctttcctctgtttttttagaaggaataaatatttaataaaatatcactggaaataaaccactgaagcagaagtcttctagcattttgtttttacaggactttttgacgaaatcgcttaaagcaatatattttttttttcaaaagactggaaatccttttttaaaaaaagaaaaaaaacaacgttttttaaaaaaagaaaaaaataaatattttaaaacaaaaagtctctctatagtgcaaaaaatgccttttcttgatttttttccctgccatgcaaaattgttaaatgagcagtatgcccatagaaacgatgcctctagatgcttttcctaatttatttaattgacaaataaaagttgtttatatgtatcatgtacaacatggtgttttgaaatatgtatacatggtgaaatggctaaattgagataataacatatacacacacttaaccattttttttttgtgtgtggtgagacttaaagtctaccctcagcaattttcaagaatacaggacatattttttttttgaaatggagtcttgctctgttgcccagtctggagtgcaggggcgtgatcttggctcactgcaacctgcacctcctgggttcaagggagtctcctgcctcaggctcctgagtagctgggattacaggcatgcaccaccatgcctggctaagttttgtatttttggtaaaggtggggtttcaccatgttggccaggctggtatcgaactgctgacctctggtgatccaccctccttggcctcccaaagtgctgggattacaggtgtgagccaccacgcccggccaggactttgttattgactatagtccctatgctgtaccatagatctcttgcacttactcctcttgtctaactgaaattttgtatcctttgaccaacatatccccaacactccctacctccccctgccccggaccctggtaaccaccattctactctccacttccgtgagtttaaacctttttaggtttcacgtatgagatcctgtggtatttgtttttctgtgcctggtttatttcacacagcacaatgtcctccaggttcatccatgctgttgcaaatgacaggctttccttttttttttttttttttaaagcaaatggtattccattatgtaaatgtaccacattttctttatccatttatctgttgatgggcaggctgattctacaccttggctatggtgaatggtgctatgaacatgggagtgcagctttctctttgacatattgatttcctttccttcagatatataccgagaagtgggattgctagatcccatggtgttctatttttaattttttgaggaacctctgtactgttttccatagtggctatgctaatttacagtcccacccaccaggtgcaggggtccccttttctccacatccccaccagcacttctcctttagctaatagccattctaacaggtgtgaggtgacatctcatagtggttttaatttgcatttatctgatgattagtgatgctgaacattttttacgtaactgttggccatttatgtatcttcctttgagaaatgtctattcagatcctttgtccattttttaaaattttttattttttgagatggagtcttgctctgttgcccaggctggagtgcagtggtgtgatctcagctcactgcaagctccgcctcctgggttcacgccattctcttgcctcagcctcccgagtagctgggactacaggtgcccgccactgcgcccagctaattttttgtatttttagtagagacggggtttcaccatgttggccaggctggtatcgaactcctgacctcaagtgatctgcctgccttggcctcccaaagtgctggaattacaggtgtgagccaccacgcccggcctttgtccatttttaaattgggtcatttattttcttactattgagctgtttgacttccttatatattttggatattgaccccttaccagatgttcagtttgcagatgtttttcccattctgtaggttgtttatttactctgttgattctttccttggctatgtagaagcctcttagtttgataaaatcccatttatccactttcacttttgttgcctgtgcttttggggtcatatctgaaaaataattgcccagaccaatgctacggaggttttcctctctgttttcttctagtagttttacagtttcaggtcttatgtttaagtctttaatccattttgagctgctttttttgtttatggtgtgagataatggtctagttttcttctttcgaaattgctattatttctatataggaatttatttcaaaattcttttaatttttttaaatctaggtttcccaaccctacttatttaacagactgtcctttccccctggtgtgttctagacatctttattgaagatcagttgactgtaaatgcatggatttatttcttggctatctattctgttccactggtctgtgtgtctgtttttatgccactgttgtgctatttttattactatagctttgtagtatattttgaagtaagatagtgtgctatctgcagctttgttatttttgctcaaaattgctttggctatttggggtagacatttttaaaaagaccctcttggctgtaaacttagggtcaaaaatatttttccagatgtttctgtcttgctgataaaagctaataaaaccaaggaggctcttctgttttggattttttctgcttcatgtttcaaacagatgaaggaatgaaagacttgtttctttttttttttaaaaaaagtcactgttttgctagttgagtcaccgaagacaagatttaataattttgaggtgggggggattggcaaacattttctgtgaaggaccacagagtgaatattttaggttttgcaggccatatggtctctgttgcagctacacaactctgctgttacagtgtgaaaacagtcccagacaatgtataaacaaatgaactgtagctgtgtttcaataaagctttatttataaaagcaggtggtgggacacatttggcctactcttgacctagttccctaggaagctcctaaagtcaagtcctgtagttggggaggagaggaagggtaagaggagctgttgagtcactcggccatatttcttctgagacacagattcttctagatctgttttgaaaatacccacatcattgttttcttattgtcttgtattccataggaggactataccctgtttatttacccacttctctaaggctggataactaggttgtatctaatcagtagggtttgtgtaaaaattgtttggccaccaggatcttggcatgtcaaccctgtgttcttcctgctccagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggtaggtggtggactcccttgtgatttggtgggatttcttgtctgaggttgtaactcatctgttcatgaattcagcaaacctctgagtattcaccatgtatctgatactgctgtaggtcctggggatacaaattgagcacaacaaagaccctgccgttgtgctgcttatagtgtagtgttggggagatgcaacaaatgacatttaaaatatccatagcatgtgccagatggtgatgagtgctatggagaaaaacactgggcaggtggataagaggatacagagtgatggggaaggggttgaagttttcagagggtggtctaggaagatctcactgaaaaggaatgagccatgtgggtatgttctggaggaagagaggatagcatgcgcaaaggtcctgaggtagaagcctgcctggaggcaccaagaggaagtcagcatggccggaatcaagccagcccaggtgggggtagagctaaataaggatgagggttcacaggtgacttatcatgcaggggctcataggccattgtaaggccctggctttttctctgagtcattggagagttctgggtgcaggagagacctgatgtggttactttgtctccattcctaccacatagatcattaatttattgaagagagatttatggcatcccgatcatgtgccaaggactgttctagatactaggagtactgtggaacaaaatctgctttgggaaatttaggttctggagaggagagacagataatatacacaattaagatgttttcaggtagcatgaaatataataaagcaaagaaaacaggatagtgtgaaaaggggtggacactaccttaggctgtgggagtggagatcagagaaggccaccttaaaaggggagaaatgtgagccgaaacatggaagatagcagtgaatgggatctggggagaagtgaatgaaggggtgactctaggtacaggagtggccacatcacaagccctaaggtgacatgaggaacagaaagaagagttagagaggaacagagaggtggtgggggtggatcttgtcagtggtgtgctagtaaatgttcaaacagctctcagcggggtagggggaaggcactggtttgtagcatttgccagtttccatggtgtaaatacttccatggaggtcagtttcaagttgttgatgtgctgtcgttgaacctggaacgtggagtcaggaagtgatgtacacagtgggcttttgtgagccgggaggtcactccagcacaccatcgcatcttaggatttgtgcttttacaaaggaacgcagtgcctggcacgcagcaggccaggacagggcctctctgattttgggttagtttccaagtctggggaccttctttatagcttcttcctgtgtctactcatgggccaaaagaaaattctatgaggtttcaactcctctatcaaaggataggtaaccataaggaagcctagaacccttgttatatgtaagggctattccaggagcatggattattccatttctttctttctttttttttccaggaaagagatataaactccctctacgacgtcagcagaatgtatgtggatcccagtgaaatcaatccgtccatggtacggtgccgaacctccaattcacatgattttggagtcacgaggctgatgtggattccatcttgttcccatggcagttataacagggcaagggaagactttggaaaacctggccaaaataatttttttttttttttgagaagaaaggatgattgataatatcaagcctagtttcagggaaaatgttaatagaattccatccaaatgcaacagtgttttgctaaaattctgaggtttgacgaaccacctttgggccaaatggcttctaatgaaaagtctttcaaatgtttttggctcgctgacagagcctgtggtgtttataaattccatttggttcactgacctccttgcagtgcaaatgctatctcatattcccaccctgactctgttgtgtaatttcatgcaggtagggatggattttactttcagccctcggctcctccttgccatgctttcatctcaaatttagtttgagccggcagaggaagaaccacagcgaattttctgtttgggggccatgtggcacacaattagtgtacaacgctcacttaggaaggggccctgcttgtgggctctgttgaaatccagagatgactttctttttcaaaaatttataatccatggccaatgcagatctgtttcagaaagaaatgaaatcttgaaaagttgtgggcaaattgagctgtgtgtgaaatgcattaagagaccttagtagcaaaaacttttgttagtagtgaaggatgttttggcgatgagaacagtcacctctctaactgatgacttttccttcctgtggccttggagactggctggtccttatatccacccttgaagcaggatacgcaagtagaggctgctctgtttgcaggtgggggagagaaaggcaagggtactgcttagcctctggcctccagctgcagatccctgtggcagagctcctagaacccacattgcttcttatgaaacatcatgcactatggcactaactcacattgatggatccagttctgggctgagccacttaaaacagctggtcgatgtggggcaaattactttctctctctgcatctcagttttctcatctgcaaaatgggcatactcatataactacttacctgttatggttgcttaaggattaaaggagataccttaaggcttggaataatgctttagcgatactatagttagcacttaagaagtgcaagctgttgtcagttttatcattatacacatgatctcatttagtagtcttaacaaccctgtgaaatatataaaaatttaattcccatttcacagacgggggaactgaggatcagagagactcaaacttatatcattattcaagggcagagcaatgatttgaacctacatatctgactctgtagcctgtgttctgaggaaaaattttactaggttccctgtgaaattcctgttcccatttcctttgggtgggaggagaaggaagctgctcatttaaacaggtttgacaacgtcagagcttttcccactaacatttgcttgccgtgtgggtgttcatttatgcccgccaggcagaaagcatgaaagcaaattcattgaagaaaatttctaaccaaggaagttctatcttatttagttctgtgaacagagaccaccttttgatgaatttcatggaggagaagctcagttactcttgcaaaatgtcagggtcctgcaggagtgtagataggggactgctgacctacaaaaacagagcaatgaggccctcaggacaggcaggaagaatggggttgcccttgagcttctgggaggcttgctgagcaccggcactgtgatgacagtcttggcttaatctaaaaggcatgtcctttctttgttgaggaaattgagcaatattgtgtcactacaatatagggtcactcccaccctaaccctaagcctaaccctaaccccagcgctaaaccctagccccaaaccctaactcctaacccctaacccttaaccccaacccaggtacccttggctctgactaggccagttctccttcactccctggtggctttttggggccttcgatcctttgcaatgccagtccctctccagcagatgactttgtaaccttggcctgaagcctcctgctccccaatgagaagaaccaaatggtacctgggaacgcagccgcctccctcccctcctgtccctggcctgaccttttccttcttgttttccctgaaagcctcagagaaccgtgaaagctctgtatgactacaaagccaagcgaagcgatgagctgagcttctgccgtggtgccctcatccacaatgtctccaaggagcccgggggctggtaaggctgagtggaggctgggctgctcggcaggtgggcttgacttgtcccttcttggtgataagactcaggtgctggccaagtctgaccccctttgtcatcctgggctggctttgacctcttgtgttaagtcccttcttaggaaggtggcttggtgcatgctctatttgagaaaatggataaacaacaatattaacaggtatcgacatatcatatcatatattgtatattattataattacaacagcagctaccatttattgaagtctttctaagtggcaagcagtctgctaattgctttccatgcattgtctaaccaaatcttcaaccaaatcttcattactccctgtgacaaaagatgcggcaaatgagactttccaagtcacacaaataaatactaaatactaaatagtgcaggcgctttccaatacacaagactgtgtgttatttccaattcaaattcgtatgctgttccatagtcccgtgctgtgtgcaatggccacatcctgaattgaagacaatacgtttttcgtgcaaaggtacctgggtatgctagggtttagttaccacttcgctttttaaccttagaagaaaaattcactgcccactgataggtttctggggaagtggttttgtggggtgacttctgtctgagagcaataagaacttgctcataatagtgagcactggtttaagcacctcatagactggcatttctgcctcccacaagataactggacctggcttaggaatctgaatagcagcatgcatggagtgcttctatgtgtcaagcactgttttaagcacgtttgaaataactcacttcatttgaaataactgagtctacatgatgactgtaaaaggttggttctgttgttacctgcattttaccgatgaggaaactgaagccttcagaagtgcagtcacttgtccagggccacatagcaggctgagatttgaaccgccaggccttttgactccagagcttacactcttaactccattcatctgctaagtccttccctgtcctcttgcaagatgccttaatccagggattatcaaactttttcttaaaatcaggagaacctcattgcaaaccaattcatacctagattccacagaatcaaagatgcagccgagttacccattgagctggagtgggggcgtagaattgccctgtttggcctccttgctgacattgctgttcctactgcagcctctgatgcttccccttggaggctcccagacccagttgggcaaccacagtgttgtccgtctgcttctcccagttcagaggctcggctttgccgaagtccctccactcgaagtggcacagagttgaggtctcttccaggcacactggcgttccctcactgggctcctgtccctgccttggtcaacatcctggtgcgcactgggtgggtgactaacaacatttttggagttgtggctggagcccaggtgactactccaaatcacggttttccattctgtgtgagatggcctcatgcctttctatgcctctgacaggcagttctctgaatttcgaaggctcttgtcttaagagactgtcagaagtccctttggcaagggactgtgggcaaaccgcccagcggctgtggtcaattcctctctctgatggcagtagtgctacctagggggccgcctgggtgaaaccggcttttttgcatacttccaaactggttccctgtagctaggggaccaaacaattattgtctgaaccaagatgctcctgagagtgaagagaatgtaaagtgctcagtcctggacagatggtatatatgatcgccgtaaatacagccagcccttgccagaagtgggtctggagaaatggtgcgggggggcgtgaaaagggcttacaacccgcagtcctgtgtctctgctaggtgaattggtagcatcagtcctcactctgcttattcagaccaaaaaattgttaagttcttcccaccaccacggagcacagacttgattaagatccagaaaggtcagccgggtgcagtgacttgcgcctgtaatcccagcactttgggaggccgaggcgggtggctcacttgaggtcaggagtttgagaccagcctggccaacctggtaaaaccctgtctctactaaaaatacaaaaattagccaggcatggtggcccatgccataatcccagctactggcggggctgaggcaggagaattgcttgaacctgggaggcgaaggttgcagtgagctgagatcgtgccatgcactccagcctgggggacagagtgagactctgtctcaaaaaaaaaaaaaaaaaaatccagaaggatatcatatagaggggaagacagatgtataattatacgttaagtataagatgtggctgcttggatgactgtggggacaggatgccaggggaccacagaggaagagtgctcagcctagggggcagtcagggaagactccgtgggagaggaaatgcccaagctgagtcttaaattagtggggggaagttgggtaccaagggcatgggccaaggcatggaagctaggcagcatggcaggggcatgatagggacgacgggccagctggagtcaacatcatggagagttaggaggtgatgtctgggagtcctggggtcagactgtgctgggccgtggctgccatgttgaagagtctgggctggattctggaggccctggggagccatcatgtggtgtggtcagaggtgcattttggagagtccctggctgcggaaaatagctcaagagatgggcaggttgaaggagggcgtttgcatgtctgggcacggccttgccgggaggaatcttagaggtgctcaccgtctggtggggtccaggaacattcatagatggattatgtcccgtgttgttagtgttgttataaagatagggaacaatgttttagctgaataataataagagctaacactattgagtatttactgtgtactaggtaggcgctgtcccaagcactcagcttatgttaatttagagtcctaataaaaccctctgagggaagcactcacgtttatgcatttttcagatggagagttggaggcacagaaagcctccaccgtcagtggtagagctggagtttaattccagcctgtctgcctccagaaccaccttctctctaaattcacaacctccccgaaataggggtgaacttttgtcttgtatggtctctgacttccacgtaaagcatggaaacttttgacttgtgatctttgattaaacattaagatcatgtgatgggggtaaaatcagcccccagtaactcattagtaattaaaaaataaaaagacagcagttgcctttgagatgctccattgtcacagatagtgacactggtcacttggccacttgctgtctgtccccatcagaattgagccagcagccgggtgcagatgagcagtagtgggtaattcatgccacctggtgacagcgcccccatgtcctctcttcttatccaggtggaaaggagactatggaaccaggatccagcagtacttcccatccaactacgtcgaggacatctcaactgcagacttcgaggagctagaaaagcaggtgagtccccctcttcgatcctcttacaggaagaagggatctgcaggtccagtttttcagggagctgtgccatctcagtgggtgaatttttccatgtgctgcttgtggtctctgtggagctctggatcagggaagacacagtgatgatagggaaattgagattgagttgttgtgggtgagttgctgtgacaagccggccgtgttttaatcaggttgtgttgggcttggaaggatttcattatgcaggagaattcccgctggagtgaaagtgaccaaatggggaatttgtcctttgcttaagcaacttgcagatgaaacacatttatattggacagccagacattgagaacgtgcttggggcgagtaagcaagtgggcctaaccagaggtgagatgaggccttcctggtgactttgcaaacctggtggttgttccctcgccgcctcttgtttagagagcagccactttcagcgtgctagcactccaccaaggatgatatctttgtaatgaggattttaagatcccgttagacccccaggtgtttattttctaagggatgtagggcaatctgggaaggcttcctggaggaaggagtatttgacccttaaaagtcaagttagagttcaacagcaagagactggcagaagagaggtgcaagtgggaggtacagtctaagcaaaggtgtggcagtgggaatgtggttgtgttccgtgtgcttgggctgaggcagagactggaagcccttgcttcctctgtactgagttgcccttacctgtacatcagcatttacctggtgcagggggtggggtttggggtggtgcaggcaaggagtggatgcctggttctgccacctctcctaagcccaggatattcttcatctcagccagaccctgggatggttcaagggtgcaatgggaggcagagctggaaagggtgatgggggctctgaaagtcttaaaagccaggtcatagagcatgggtgttgcttccacaggacatggggagccacagaaggttcttgagccgggctttagtaggcaaaatagtctcattttctaataaggtcagataaatagtctaggatgtgtttggaaaccagatctgaggaagcattatgaaacctgttctagaattcacaaggcacgtttttacggattggaaaatgaaactccgaacctcctggcaccctctccccgccaggtccctatcagctccatgcttcattatttagctctctccccatggacgtatctggtaatgaaaatgcattttaaacagttccacaggcagtatctctgctaaacggtgtgctttggaaacgggttttctttttattattcccgttacaactaacgtgagttatgtcttgtttcttcacagattattgaagacaatcccttagggtctctttgcagaggaatattggacctcaatacctataacgtcggtacgtgcacacatcatcttagcctggatttccacccctatcccccatgggctgacctcagccccgccctacacagggaggtggctgacacagggtcctgtcttgaatgccagctccttccctggctgaagctgagtatttaggtcaggctggtcagtgagtatgatgctatgtctgctattaatctctactaaaactgtaagtgctaaaacaaggtctcgtacataagtgctagatggtggttagcggatattattaccagcgtcactcttattatttcaggatccatctgtgtttcccatgcgttgcgaaggaaagctgagctgtcagcctggctgaaatgcagcgtggagttgggagtcttgggttctaaacccagctctgcctctctgtcgctgtgagactacaggcctgtcacttctcctctttgaacctctgcttcctggttgctcggctggggcccaggaaacccagcccgcccacgttgaccatgctgcaacgggatgtgaaggcgtggccccaaggctaggcttgtccagtggtggccagggtctgatgtgtgctgggtttcctgggtcttgagcctgcctgctttgaagtgggtgtggtgcagctcccatgtgaagggactctgtagcgggcctccttgttctgggcagcccatgaccctccctgggcaggcacgggcatgctcccctaggactcaggtgacagcagccccaggaacttcctgcttctattgccaatgctctgctttacacattcattcatttattattatttcttttcgcgatagagtctcgctgtgtcacccaggctggagtgcagtggcgtgatcttggctcactgcaacctctgcctcctggattcaagtgattctcctgcctcagcctcctgagtagccgggactacaggcatgggccaccgtgcctggctaatttttgtatttttagtagagctagggtttcgccatgtgggccaggctggtctcaaactgctgacctcaagtgatctgcctgccttagcctcccaaagtgctgggattacaggcatgtgccaccatgcccagcctgctttccacatttataacctgcttctttacctttacaatgatccagcaggataggtaggagagggattctttgctccgattaccagatgggaaaatcaaggtcctaagtgaccgaccaccacatgtgctgaggtcctttgggcaggggggtgcaggatccctgcatccacttctggtgctctttgtatcatcttcccccatccctgtatctgcagagcagaggcacatggctcattggttctgagtagaaatcttggagtcaggtttgaactgagcctcagttttactactactagctgtatgactttccacatgtgactttctcttaatgagcctcagttttgcctcctgcaaaatgggcctagcaaaagcagggtgcctttagtctcagctactcaggaggctgaggtgggtggatcccttgagccccaagagtttgagaccagcctggataatgtagcaagagctcaaaattaaaaaaataaaataaaataaagatgcaatacatgtaatctgcttagaatattgcctggtatataagagctcagaaatcttagctactaatattatttggcagataagtttccctgtcataatcttttcttctctgtaagatcctttctctgtgtctggagaacccacgccacatttctctcctagtttctggtgactctttggtgtttttggctcatggctgcattcttcagtctccacatttgcctgcacatggctttctcccttgtgtctgcatctgtttttaaagccatttagctgggtgtggtggctcattcctgtaatcccagcactttgggaggccaaggtgagtggatcgcttgagctcaggagttcgagaccagccctgggcaacatggcgaaacccctctctacaaaaaatacaaaaattagccaggctttgtggtgtgcacctgtggtctcagctactagggaggctgaggtgggaggatcgcatgaacttggaaggtggaggctgcagggagccaagatcgcaccactgcacttcagcctgggtgacagagtgccaccctgtctcaaaaaaaaaaaaaaaagccatttaaattatttattctttatatgtaaaagattatatgtaacaacatagaaaattatgcacaatatgctaagtgaaacagttcacaaaattttatgtattgtatgtaaacattttgtaaaaatgccaagttgcttagctatattttaaatatttttaaaatgaacatgtattgttttagtaatttgtaaaaaatatttatgatgagtgtaaaaagcattttctaattggtcaaccaaaaagatattcagtgtttcttttgatcaagacgaacacatgtctataactaaagtggacaagagggtatttttttcaggttctctcatgcattttaatgtttgtttttttttcctgcatcttaagtgtccctctcctttctcttataaggatactcatacttgttggatgttggaattgccctaaatccaggataatctcatattgagatccttaacctaagtacatctgcaacgaccctataaggtcccattcacaggtactggtgacctgacacatcttttcggaggaccctactgaatctactgcatcccttgagtagtcatctgtgatgtgtacttaccccgatggaaagtagacgtccccatcagtgctaaccgtggtcatagcagtggtggttggtccatgagagaaacagctcaggcagggtgcagtctggtctttgtggccctctaataggctgattgggacatttcttattctcttaccccaagtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggtaggcacctgctcacccgggtgcaggtgggcctggcattctgagggctttggtgctcagttgggactgtgggtgggtccaggcagcaggatgagcaggcccaggtcctactcagaattcaggaaggagaccaggtggattcagacaattggagcacctcttgttagagagaggcagggatagtggaggtgccctgggaaggtgggtctggttgtctggttcgaaccttcagaaggctgagtgcctgcagcaatgctcattgatgatgtctttgcggccctacatatcttaccaaggaagttactgccttcctcattttgaatattttctttctaagtatcatataaagcagtctggatcctcctgacagaaaacgttcactgagctcacctgcctggagctggaatgggctctgggaacatagcaaatcagcgagacccggttctttccggtggaggaacttcccctctagatgggagtgaccttttcagggctgtcctacctgaagtactagtctctggctggaagtgttttgggaaggtgtgagcttctggataagaataggaggtctggaattgggcagactggagtttgcatcctggcagggctggaccctgggcaagtaaccacacttctctgggcctcagtttccttgtctgcaaaatgaggagccaaattcctaactcacaagtacttaatcactgccttatcattatatcagagcgacatgggaaagtgccaccctgtcttcgatgatggagtaagggctgtctgttcttgtggctgccgaactggaaagaaattgtagggtttcccatgcacccatttgtttctaaggtagaacttgacccaaagggctgattaaagccttcctggggcctcttgtgccctctgacttctggctagagtcagtgagtctctcctccaagatagtcacccaccagtggccaggtcatttttttccccttgggagggcctcacatcttggccagtccctggtcacgagaggatccttgactcactcaactcttctgcagggaagtgtcctctttaggagactttgcagaggggactggtccatgggtgccctcgctggtggggcatcgtctttctctgacccaggaactcctgggggccttccctagggctcctaattcttcccatggcttttcacaccaccagccatgggggaggaaccatgagcttgtagccagctgcgctgtccttctggctttcccagtgaaaccatctcttctgccctccagtgtctctgatgccacagtacagctctgaggcacagggaggtgccacgaccctgaggtttatttaaaaaatctccaaatagtgcactccagctctctctactttgcttaatgtggaaaagtgttatttccctagaaggctctgtctctcccctgcctcacacctcctctcctgccgcgtgaaggttcctgaaatgaagctgagctgttcaaggttgctgttggcggcctttggtctgcattcctctctaactggtttttatatttactgagatttcatgagaatgatttttaaagtcctgttattacatctgaggggtaaaaaaactgggacagtagagttgacggagttcccacactgggcacagctaccccttttgcggagctggtgttggggagcaaaggaagaaggccccatcccactcttgggaaaccagcggcggataaactctttgtcactgccaggacctctgcctgtccctaagtgcccgcattgttacacggtctgtagccacctcattgatggcagagggcagtcacaaaatccttctagttagtgggtttccagagcctcaccaactgtattgtgacttcccattctgagatggcttgaggggtgacagctgcaggcctggagagtaattgtcatgctgttttttgttttttttttttgagacagagtctcactctgttgcccaggctactcaacttctttgttaaatggagataattctccctgtcagggtgtggattgacttaggtaatatccctcaagtgcttagcctgtgacggctagagctaagcaccccccaaacagtcaccattattatctaaatattctctcaaggtccccccttggccaataaaagtctgatagaatttggggaggcccaacagggttgcctgctttggggtgaagtgagaagctcatccttacatgcaaggagttagatttgatggtgggtcttctgaagggaggtacctcctgagtccatggcacatggcctgggcactgggtagtggtccccttggacagagccctgatgggcagtcagagctggggagcaggtgtgcaggttttgagggtgcaggggatagagagttatgacgaggatgctggggtccacagagcccccgaggatttgaagaactagaatttgagacactctaacagtgtggctttaggggaggggacaggaggcagagttaaagacagaggggtggtgacagagaagagcccccttccatcctgacctcacctatatttgagggctgtggccaggactgagctgcacaccaaaacctcgtggaaacagctttgtcgagaattttcacagtgagaggaagaaacgagaggggcagggttgtcttcaggaaaggaaaacattcaaccatattaaagatccgagtgtgcaagaaagcaaagtggggatggaggaggaaaaatgcagggcgagctgggaagatgggatttctcgggggcgggcactaaagacagtgaactccaaacaggagaacaacatgaagtactgggagaagaaccagtccatcgccatcgagctctctgacctggttgtctactgcaaaccaaccagcaaaaccaaggacaacttaggtaacatctttcccaagaacatgccctataactccaatgaaaacttaacttcctttagagtctgatattttcagagggggcagagagtgcattctctcattcttaactactcccagtagatggccccaccttgggtttgtcctccgagtgagggagctggtggcagaagcttttttggtgtattagtccattttcatgctgctgataaagacatacccaagactgagtaatttataaggaaaaagaggtttaatggactcacagttccacgtggaggaggcctcacaattatggcagcagaggagagagaatgagaagcaagtgaaaggggaaacccttataaaaccatcagatctcgcgagacttattcagtaccacaacaacggtacaggggaaaccacccccatgattcaattatctcctatcgggtccctcccataacacgtgggaattatgggagctacaattcaaggtgagatttgggtggggacacagccaaaccatatcacccacttagtgggtggatttagttcttactgccattaccacaaacttggtggctgaaaacaacatttattcttgcacagtcctggaggccagagtctgaaatcagtatcatgaggtcaacatcagggtgccagcagggctgtgctccctccggaggggaaagccattcccttcttccagtttctgggggctgctggcattccttggccttctcctcttctgcttccctattataaggacccttgtgatgcattaggtccacctggatattccagaataagcctcccatttcaagctccttaatcacacctgcaaagtctgttctgccatataaagtgacatgcacaggctccagatattagggcctggacatctttgggggccatttaaaaaaaaaaagaccttctaccacattctccaggtagcaagctttttgatgatgctgtacgtatttttttctttgggtgttttgagctgcttccatatctttcatcttagaacagaagaccagccagacaatactagacccctcagttaacttaccgggaggccagtccctaggaacttctaccttcagggactcagcaggctcagcatgttgactgccgggctatcccaccacagctggatgggagagaagatgaggcctgtccccttccctctcctcctgttctcccttccctgcacaggcacccacattgcaaccctacctgtgggctttggcaggtgattctcagtttgttcatcttgtgtctgtggtctctctggatcttcccctcccaagatcttctcctacccaaaaccattcccattctccctcttctataactgtaccacttttgtgttttcttgttcaaggatggtgatagtttaaaaaaaaaagtaaattacagtaattctagcctaaaaggtggtgggaaaactaggcccctttttaatacttggaacccccagagggcaagagtccacagtgataccaattgggacaatatcatcagaaccccttgaatgtcaaagagggagattcctggtttccttttataatctgagcatccagccattgcagcaaacattaagaaaatgcacagatgagacacagaagtactgatgacctttttctctgtgtgcagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcaggtaaaggccgactgaaggtagtcccgtccctgcaaggtggcggttgcagtcactccaggccgagtcaccttgggtcagcgataccatgtggtgtccaagaatgagtgatttgtccgagggactgcacggttcagcagagtaatggttagtatgaggtccagcagctgaatggagggatgagaggaccgaaggctgcttggcttacgcaggcttcgtgattgtaagtaagtgacagaggctgagttagtctggcttagaaaaagaaaatgcattagttcatgtaattaaagcatctttggagttctcttctccaggcctgttgctgtgtgagggctttctgctcagactttcttccagagacatttacatgctggcataactaacatacacaaacttctggacacaaagtgatcgcataaatcacggggctttgtgcttttgttgttgttatttaagacctctttcgagggatctattcatcagtagcctcctttacattctttttatagccacatcggattccacagaatggaacaatcatttatttaataagtccccgtggaggcacatgtaggtattccccattatttgctgtcatagacagcactgccttctgtaccctgacgtgagcgccattccacagatgtaggaatatgtctatgggacagaattctcagaaaggcagggtgggtcaaacagcgcttgcattttgatcaactttgccctgaggaaaaccactgaagacgtgcctgagctaagccacactgccaaactgccctccatagagatcgtgggcggggatgcaaataggtggaggttggagtacgctcttttggtatgacttcgctgagttttgttgaactttttgccgtttgcacaactgagaggtgaaaactgatacatcgtcgtccattagagcttcttcttgtaagggacattaaccagtttttccctcatttagggagcagtggcattttcttttctgggaactatttgtgcttcttacctgatgtatctactgcagtaggtatttatagcatagatgtatcagaactaagaggttaaaaatttatattcacatatttgtcatttgaattaaaattgcctatgcaatttattgctacatagacacttttagcaagtttgaatcttttcttttatgattcgggatttggtgacatacttggaaaggtgttccccagtctgggagtttgctgtctagaaaccctatattttctttgagtgagatacctatttgaacagctgcctcacattaatttggggaaaaggtgaaattcattccccacctagaaactcctggcctagggggccagcgtgctcatgcctgacttacagcaggcgttcactttccttcccagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggtaaagccagccctcccttcctgccaggggagccagccgccctccctgggggctgggccgatgctgtcttgagagcagggaacccatgtctagggaggctggttgtcttgtttaaacgatccccattcaggcagtgtttgaggatctttctttcttacagtacactccggggtcgttctgggagaagagggaagagaggggaaacctcctcaaacccacttccccttgtcctctgtgggggtgaggtatgaccctatctttctggggtcctggtgaggtcagcctctggccggaaagagaaagaaaacatgggaaacagccatttggtcttaatggagaagttttttcccttactttgtccaattccagggctttttaaaattcatctgactttcagagaaagtgttgttgctttgtaagaatttttgaaaagtagagaaatgaattgcatttctcctaaggttaagggcgggcgggtggtagggggaagaagcatacgtaaacacaggcctttaaataaacagcagttataaaaagaatgccacactgttcctcagcctttcctaggggtgtggaaatccagtgattaagctctgccttgatcagaggcacctgcttgggcatggatgtgtgcattcatgagctcaggtgagttttacctgttgagtcaggtggcatatggggccgagacccaggctgatgctgaggaactgtgggatctaccacagtccaccttcatccactgcagaaggttgctccggcttttccagtgaatctaggaaaattagggctggcattgaactcatccagtgtcactctagaacccagctgcaatccacgctaggctgcctgttcaggaccccaggggggttccaatgcttccctttggtgtcccaggttctcggtgctcgccatctccccaaacttggacgaagtattgcctgtccctttgtagaagtggagatctgtggagccgagtatgacaacaacaagttcaagacgacggttgtgagtaagtcagtcaccttggcccctctgcttttaaacgtccggccagtgaatcctttgtgggagtgctcttcgtgggggattttgcaatgctctttagttgtcccagggttttctttcctccctcttgcccacatggttcagcttgaggaggggatacatacaaagggccactttctgaaatccttagactttccccagtgctgtttgcctgcctgtaactcaagtccggaatcgtaggtgaggccctgacactaggttggtcctctctgtgcaacagcccaatctgattaatctcctgagtcaaaggccaagaggcagagacacagagagagggggtgaacctacgtggctgacctgacccagaggatcagcctaacctgggagatcttagcccctagagggcaggagggacaagaggaatgcttgctcttccaggaaaagccaggagggaaccgtgattggtgggccttctaaagcacaggatccttgcccctggtaaaaagtagcccaatgaacaactcagatgctgaccaaataaactggcatttatggagagtggcaggattgctgcttgcctgctctgtgaggctgggctctcccctgccagctgtagaaccccctgctggtggatgtggctcccaggctctcctccccttttgtcttttccaaaatccaccttcctgctctgcaaacaaacacctcccccgttcccttgtccctgatcctggggcggggagatgggaggtggtctccttcctctgctcaccaagggaccagcctgcaacagcagcttccaggattgctcaaggtggggtgggggagtgaagataattattcagattttcttagatcttggcatagatgcatatttatttacatggttgctaaggggattcacagctgaaggatgcggagattgtcttaccagaagggggcagctccaatgtggcctctcatgagctttgatctccttccagatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggtaagaggcattttaattaagatgttcgatttgggctggcgttgtactttggtttggctgctggcttcaaaaagaatgaaaaatgatttttcctggtttggatggaatcactgtaaaaccgattgggtggcttggagagcaggtgtacagcctgtcgtgtagcacacaggtgggaggaagtgggtgacaggggaggctatgcccctcaaagtgggatgtttacaagcaaaactggattgttagtggatcctcaacctggcactgcagtttgatttcattttgaaatattacatgcggtttgcttctccctagctagggctaagtctggtttgatctccccctcctgctctctggctggcagtgtgagagggtggcaagggagagacctttggcatcttggggggggagtaacaatctcgagggtccaactccccaaacccttcagaattcaccttcttcttctataaaattgggtgggttaatttacttctttgagttgttacagttttcttccctgctgaagaaaacacaagatcccttcatggtataagaagggtcattttgtatttttctgcaaccaagccaagctgggtcatacgaccagctcttaagaaccctgctgaatcccagatgactgagcccttcctacacagctgagatagacacttccaggtgaggggatttgggaccctgctgcttctagagccagtcatttacaaaaacaaaaaaaactggctctccttagcttctatatagtttctctagtttactttcccactggatctttcccactggattttaggtataatatttgacaaataggcccttgctggatgttgaattttccttcttcctcttcctttagtatttctgatgcatggtgcatgagatatgagatcatagattcttctggattcctcaagaggtcactgttcccttgttttctgaggatcatttttcaagagaaagatgactgtcattttagttacttacataaaaaaatacagtcttttgatattgtttggaaacgtggggctcaatgaagagctgaattggatcttttttgttttcagacattccctcaacttccacctttttttgtataatatcataaacctgaccatttctgctactgggcaggagcccagtttctgagcagcaggcatgctagaaaatccaggtgctggccgggcacggtggctcactcctgtaatcataatcccagctacttggaaggctgaggttgcaccactgcactccagcctgggtgacagagcaagactcagaagaaagtgcaggttcctggacccaccacagggtgatgagtcagcccagggtggggccaaggaatctgcatctttaggcagctccccagatggtgcttggatggcactttgacagaaccaaactatgtcaaggctgcctatcttaccattgaggaaatgaattccttagcaagttactagatgaaacaagactttgggaaaatgtttaaagtttctgatttttttttttttttgtactctagaaatgttcattttcatgaacattgctactctagcaataataatgagtattcatttgtaagaggcctgatatttggcaacccttctgggttaactcacccacactgtaaactcccccttttttttttttgagatggagtcttgctctgtcgctcaggctggagtgcagtgggtgatctcggctcactgtaacctctgcctcagcctcctcagtagctgggactacaggtgtacactaccacatctggctaatttttgtatttttagtagagacggggttttgccatgttggtctgaaaaaaagtgatgggattaaaggagtgaaccactgtgcctggcctataaactactttaaacccggcactgatcagggctgtgattccttaatttgcttcttttagattagtctaataaggcttaggaatgacaccaattcttctggtgcaggaagtgtagcttttggtacacctttacgttcctagccttgacgctgtaacagatttctttttatggtaactgcctgccagttcctctactgaactcatccagcagagaggggcagctgtgctgaaaccccttggttaccccgacgtcctcttgaaggatgagggccttgagcctcataacccctcccagtgccttgcagagatgtcagagttgatgataaaacctcgttaccttaatgggcatcaaagtgtgtcaattcatctgcagaatgcaatgacttagcttggagatttggaaaaaacaaaggtcaaaacctcaagggagattaaaaatgtgaccttctcctcccccgactgtgagatactctcagcagggacctttcctcacttctttctagctcctagcagtgcctggcacatccatattcatgggaggaatgaaatagaatgaacaggaggcattgagggtcttccatactgaaaaaataaacttcacccattgtcattagagatgcactgaagcttttaaaccagttggagcgcaggaaggaaagcagcagcctttattgtgttaggtaccttaaactctttctcttttaatcctcacagtaatcctgtgaaaggggttttatctttggttttaaaattctgagcactttgaggccgagagactatgacttaacttgctcaaggtcacacacctgtaggaccagagctgagattcaaacccaggaatgtctaattaatttcgaaccccgtgttcctcctctgcaggctgccctctcactgggtgctcaaagccagatgcattgatcttactttaaaaggtgtctgtatttccctttccccagtgaaatgactagaaacaagaagaagaaaaacaattattttttttttttttatacaaggagggctgcccagtgcataaaaatgggacttgggcagcgagagaaggtacatagagctggagacagctggtcatgagggcagagctcatgtctccgatttaagaggcacacgcctagtgtcagatagtactgtccagcctggaaccatgctattggagtgtaggggctacctgatagcctcccggaatgccatggagcaaacagtcattccagttcattctaacagtcaatcagcagctagactgtattagtccgttctcacactgctataaagacatacctgagactgggtaatttataaagaaaagaggtttgattggctcacagttctgcaggctgtacaggcttttgtttctggggaggcctcaggaaatttacaatcctggtagaaggggaacaagcacatatttacatggccagcaggaggaaaagagagctagtgaagggggaggtactacacacttttattaaacaaccccatctcgtgagaactcactatcatgagaacagcaagtgggaagtccacccccattatccagtcacctcccacccggccccagctccaacagtggagatcacaattcaacatgagatttgggtggggacacagagccaaaccataacatagatttcttcaccaatgtccacagattagctcattagagatgcagaatctcaggcctcaccccagacttcccaagtcagaatctgcattttaacaagattcacaggtgattcacatttgcattaatgttggcatatcactgggctagtctgcaagaattctgagtctctatcaaggcaaaaaacaaactagcaacaaaaatcacattgtagcgatagggaaaaataggtcagaaaacttctttacagcagtatattcaatgagagcaatgtccccataaaccctaccaggaaatgagtgggtataaaacattcaggttttataccccctcaaactgtcactcaagtataaaatcaaaggatggatgctctcaaacatgcacagctcaggaattctgtgtcccatgggctcattttgaagagaacaaaagaggacaaatttagccaatgaaggcatccacggaattcagtaagatgatgagcatccagccattaaaaaatataaatttgtacatttccttatgtataaaattgtgtatcagaagaggaacactgtaaagtaatactgagctctgggtggtgagatgcatgctggggaaagtatattgatgtctttgtcatactttgaattgtatacataaataagatggattgatgggtagataaatccatgacaaaacaagtacagtcagccctctggatctgtggactcaaccaaccaagcttgggttgaaaatatttttgaaaacattatgtatcgaacatatgcagacttttttcttattccttaatacagtataacgattatttacacagtatttatattgtcttgggtattaaagtaatctaatttaaaggatatgggaggatgtgcataggttatatgcaaatactacgccactgaattaattatttagagacaaggtcttccctctgtcactgaggctgaaattcagtgttgtgtgatcatagctcatggcagcctcagactcctgggctcaagcaatcctcctgcctcagtcttcctagtagctgggactacaggtgtgcatcactgtgcccagctaaattttttattttattttatttcttgtagagatgggggtcttgctatgttgcctaggctagtcttgaattcctggcttcaagtgatcctcctgccttgccctccccaagtgctaggattacaggcatgagccaccgtacttggccaactatgtcattttatatcagggacttgagcctccaaggattttggtatctggggaggtcctgaacgagtcccccatagatatcaagggccaactgtagagtaaaagtttcgtacaatctaggtggtgggtatacaagtaatccttgtaattttttttagtgttgctgtatgtttaagaattttatattaaaatgccagaaaaacataagcctccctttgtgggagaattatggttacaaaatggaatgcaaatattatataccatgtccatacagaaatgacaatacaccttaggggtgtaaaaggagaaattggggagagaaaaggaacaggtttgtgtaagaatgtgaccttcctcttcataagcagcggaaagtgagagattcagtggatattgtttgaaggtgataaagcaactgagagtataaaatgttccaagagaaataagcccaaaatctgaatggtggaaggcacagaggaaacagtgggagtgtcctattttgggcattacttggagaatcagtagatatgatataaatgctttcaagacaaactaggaccacagaaaccatctctgagatacaatgctaactgggtaaggcactatcatttgtgattaaaagcaactcaaacatatgcataggcaatcttgggaaagatactgttaaccatggttccttttaggacagagaggaggattgggtgggagtgaccgttctgtttcagccctgtgttcttttatactaaaacaagccagcaaaccaacctttgagatgtgttgccttaaacattactgaatgggggtgggggagattcggctccaacttgcccccctcagccccaaataaaaagaaacatttaaatgactgtgaaagacaggtcctaattgtaaagagggaatggctttaggaggaggaagatcaatactgctatgaactactaagggacagaaagatttcctcccattggaaatctttaaagataaaacacactccctggtcctgtgctttgtaaggctgtaagtggaggaaatggatgaggattcactactcttttggtctcaggagtatttaaggaattgaaccacagctgcaatcactacactcaatgtggaatgttctgtgggttttaatttcttctgagtgaatcatttttatttctagatggtagatatttttaaccttgcttccctgtatggaccagtcagtcatggctgccggcctctgtccctaaccatcaggataggacctctggcttccacaaagtcagcccccagcatggggcactgacttctctaccctttgaactaggcctatgatcccgaggtagcctccaaaaaaaatctaaggtctgacattaattacctgcctttgcattttcctccttgttctgcttcaggattcaggtccgttcctctgaagaatgggtacagcgaggacatagagctggcttccctcctggttttctgtgagatgcggccagtcctggtgagtggagaaacaccagttaagggttccctgagctatgcctgctggtgagggtagaaacggcccgtgaatacaattggcagatggacttaagcccattcagaattgtctagcccaagcatgagacatcatacaagaattcctttttgctaattccccagagtgtcctgggttttccctcccagcatcctcctttcctggagaatgctgtgtgattctgtgtaggcagtgtaggaaagggtgccggtacttgtaagttccccatagtttcacttcagcaagagccaggccagatgatgccttcctagatagactcatcctttctggatgctttttggtgccagtgcatctttaggaatcctatcaaaaagtctgatagcctccaatcaagtagaatgaccataaattaatcaccccccaagctgagcatttagatggaatccatttacaaataaggcgatcatgcacagctttaggtgagtacctttttcctcctttacgccagaattctttccttaggatcaatactcagatatagaattagtgggatcaattaatttagctgaatggtaaaactgtaaaacctgggctttagcagaagccttaaaccagtgagcatgaagaccctttgcttagtgaagcagaccctttgcttagtgaagcttatccctccccagctcactgaagatctgggatttgtgcatctattgcccggggaaagggaaccagtgctgcttctctctatacataaaacccctccgcagacacttcacagaaaagtcaagtgataaaaatggttttagattgtggtagggcagcatttgcctaggcccgctgctctgcaaggctgttgtaaacaaccggaaacattataaataatttaagtgattaggtatcaccagcagcagagaaaattagtatatttaaaagaaaattgtgttgatgcagatttgacttccttgatgagggaagcttaatgccggggctgccactgtagggagccaggggcgttgtgtggggttctaaatggaaagtcgacgctcacaaatctgctttctgaaagttttctttagttcagctgctaggtcttgagatttcatttaattccacatctgtcacctggttctgtgccactcacaggtgcagctcggcatttctgtccacactgggatgaagagtcgctcttggaagccgagctgaattgcattcggtagacctgggctttctccttaatgcccacggtcataccttttatttatcaccatatcctctggaagccagggagaaactctggtaaacagcctcaatgcagacttttctgagcaaatgattgatccagtaagggctaagatggagtttactcataaaacctttgctgagatagagtttacagccccagaaaactgtcaataagcactttacacaccttctgaagaagccatttacatgtcacaattactttatcaagtcgcagtcctttactttgctagcagtatgtttgtttagtttataaagagtatttttagcaccattttattacctactgtattttatttaagatgtaagaaaggtgggggagttgaaaagagtcccccagatagcctgtatctaacgaccgttaccatcttggtagatttccattgccttatgattttttgtatatgatatttccatagtcagattcatacaggtgcccttttctacttcacagacgactttaaatgattttcaaagccattgatgcctgtttcatcaggtatgggtccctaattcacttatgctcctactaacggagagtcaagtcgttggcagttctttactttataaataatataggtcttcatgtaatattttctgattaaaaattatttcccaaggctagatatttagcaatggaataataaatcaaagaaaaaaggaccatgtatttttatctgcatgtcaaattgttctctgcaagtaaatagtttctcctaagttgtcgtattatatcccatcttgccattaactggaataggcctccactggaatgatttaacatggtgagatcccgaagaatgggactggggaaaataggaaagcttaaatagtcatcatcttccatgggcaaactggccatttctggagggcacatttgagaaaactggctgccccacgacctgtttagtactgatcctgggtggactgggttctgttttgtgctgggtaggagctaacctgcaaggggtggagaggcccttctttagagtggaagaaaacccaggatgttgtgcactagattaaggcttatcctagagcagatgcttgaatccctttgtagaagattgcacactttagaatcctggaggtccaggactgggagctgcactctggcactgagctggtcctggtttttgaggttgggaaagatttccttacacctggggagacctggagggacacaaaggccctccttatgcctcatcagctaaagttggtcagtttgcctaatgctggctccaaagagcaaaaactgctgtgtttaacatccatgacccaagagtgtgacatgactactgaacacacaaaaccatgagcatgcagtggaaaaagaggaagacagactaaggtacacacctggaatagatggctggcagttgaaactgagccagtggaaacctcagatgatgagaactgtaacacataactcataggatctttcaaagacatccaaggagagcactggagaaagctttctggaattcagagaatagacctgatttgttgcattaaaaaattcagtatataaagagatctgcattagtgacaccaaagataatgtgaaggaaaagtctcacaatctagggcaaccccaccatgagatggaaagaaaggaaaaggtgggctgggaggacagatgccaaggacctaatatgaaagcatgtcccaaaggacaaagttaaacagacggtggagagctattaatgaaatagcgaataaaggaagtgtttctctaatctgctgcttctgagggcccacttggttgcaggtgagatgaatagaaaacacatccataccctcagtaatatttcagtaaaaatgttaagttccaaggataaatttaaaaacctggacttccagcacactagttgtgtataaaggaaactgaataagtctaatatcagacttgtcctctttggtgctgaaaactaaaagactcccaaagtgggtagaatgtggactaggaagacggaataattcagtgtccagcccccgacatgtcaaggaatttcaaggtatgcaatattttagatatatcatgtatcctactcaagggaaatcttgaggcagcccctgaatcgatgattattttagtcagaaaagaaaacttttagatagggaggtgaagagagggaaaccagtgaataattaattttgcagtacagttacatcttacaggatgatgacagtgtgataaaaattttgtcatggtaaatatcaaataaggatttttgaattggaagaaatataccatgataaaaaatgacaatcaaaagctaaaaaataatcaagtatcaacaaagcaaaggcatggaaaggtaaaataaaggtatgctaaaggttatttcaactttgacgactagggaatcagtcagtaaataaactatactgcagagggagatttaatgctacatctgatgttaaaggaaactgtgattttagttagcattgttagactgagggtaaccactgtcagaattgaaaaacagacaagaaataaggaggaaaaaaggagatcaacataaacttgaccaagagagtaaaaataatgtaaagaatcagaataagttaaagcaaggtaaaatgtgtagtaattgaagtgaaatggataagaacttacatttaatttggtgaataggctgaatcctcctattagaaaagaaatctacctgcagtgtttacaacaagaggcctaaaggcaaggtaaataaaacaaataggaatggatggaagagttactgggaaaattgggaaggaaaagttaacatcaatctagaatttacgatcagaagtactacagtgtattaagacgaacaatatgtgatgataaaatgcttgttttctaaagggatataaaagtcattagcaaatagcatagtacctaagtatataagacaaaaattcctacatatacaaagacaactgtataaagaaaaaatctttcagaatttggaaagtcttgtatataagaaatcagcaaagacataatatcaaaataatttgccttaagaaatatacaactttgtgtcctacaaatggataacatacactattttcttctgtctcaaacttcataaatttgattgcattcgttagaaaactttaatacattttttaaaaataatgatttcctaagtcattggctgtaactggactagattcaaaagacacaaaaagatggcaaaattgctcacaatttgaagataataattttctaaatatactaaaacaagtaaattacttagaaagtaaaacatttatgccatagttacatttagaagaggaaagtgcttgccttaaaacttcacaaagaatgaagacgtatgtactactaagtattcatcttcagaacttttaaaacaccaataaaatagaacaaaggaataaaagagatagaaaccaactgaataaaacacaaataaaaataaaaggataaaaagaataaaacattctggtttatcaaaaaggccaaattttgttttgagacagtgtttttttctgtcacccagcctggaatacagtggtgtgatcatggctcactgcagccttgacctcctgggctcaagtgatcttcctgagtagctgggactacaggcatatgccaccatgcctggctaatttaaaatttgtgtgtgtgtgtggagacagggccctgctttgctgcctaggctgctctcagatcctcctgccttagcctccccaagtgctggaattacacgtgtcagccactgtgtccagccctcaaaagaccagttaaactctttgcctacttaataaaagaataaagaggaaaaacatgtaagagtaaatactggaaaggagactgaaccccaaataataaactacagcaaatggatgattaccttaaagaatgtaaataggctaaaattgttctgaaaagcagtagaaaagttaaaacacctattagataaaacaggtttaggatctagatggttttatagcttagttttgtcttcatttaaataacgtaattccaatttcactccaccaaagtaagaagaacaatggaaatccttcttctgtcttgaagctatacaactttcatatcaaaactggagaaagatagtactcctagctttcccctaacctcattcagccgtagaccaatgtcatgtgtgaatatagatgttaaacttcaaaaaatagcaaatatccagctgtttactagaagagcaatatattacaactaagcatttattctggaatgcaaggatggtttaacaccagcacagttagcaacaaattaaatatgaaaaaagcataaactagtagatgccataaatgtaaacagccaaatgaaataatcagtataattttagaaaaaaggtcgagtgatctctattgtatacaaatttaaactgtacaaattctgattgtatagtttacaaaacaggaagacttcaattttaaagagactgatgtttatttttcttgtatttattgaacgtaaccacttctgtctgttctagaagtaacaaacagaaatgtggtgtgggaggaagggacaaatgggacatcccatttgtgatactgacaaaaaccataacacatttaggagtaatttaaataaaggtacagaacttatataagaaaaaaacataaaatcttattaaaaaacaaaacaccatgtgaacaagtagaaatttataccaacccttccaaaattaatgttggattggaattggaggtatcaatataaactcaagttacatatatatttatatatatatattcacacgtagatgaataaatgtgtgtgtttacatgttactacaaatacatacatatcctagctcactctgctgagtgcctagaacttatgacaccccagtcattggattctcaattccagatattgctaaatatcatatgccaataaaaagaaatcagggctccttagacaagtggttgatttccagacatgggataaataaaatataaaaaggacctggagcatcttaacatttcagtaaataaagaagtgctgaaaaaatggtggaagcacatcaaaggggcctaggaaccaaccagggagcgctcccaatggccacagctggaaccatttgcatagcaaaataatgataatatcagattctagcacacagaatgaaatagccacatgtctgtgaatgaatgaatacatgacagagaagagatagctcttccttacaaatgaattctgattaataaatgtagaaggaatgagggaactagaaaatcactattgaaacagcatagtactaactgctgcagtaagacctactgatgaatgcaaaatgaaagttggaggagaaatatatttccattgtcccaaaagtgtcttccgccaagaaatttatcaattagaaagacaaaaatagcagctttacagcggatagaccctgcagctaccatcttaatcagatgatcaacgttaccaaccacctggaataaggcaggttgaaatcacgtacttcctgaggtgagacgctgagaagggtacattgcttctgtgacattcttgccaaaactgcatcgcctcaaacaaattataagaagacaccagacaaaagttgctggacattcatacaaaataactgactagtattcttccaaagtgtcctgagggaggaatgaggaaaccatacagattgtaggagactaaggcagcacaatgactaaaggttctgtgggatcccggattggatgtgggaacaggaaaaggagactggtggaaaacccagtgaaatatgaataagatctgtagttttagtattgcaccgatattaatttcttagttttgatacttgtactgtggttgtgcgagatgttaacactgtggagtctaggtggttggggtatgtgagaacattgtactattactgtaccttttttgtaagcttaagcttccaacataaaacaatttaaaaggtattggtgggggaaaaactttatttttttgtgtatttttccccccaacaaacaggagaaaaactaaaggcagagagtgccataaagattttgtctcaggccaggtaaaacttattaccaaaagcttcattttctaataaaacaaactaaatttttaagtgaaaactcagactcaaaagaaatccaggaaataagtatcacaaaatgctttctcttgactagagtggtggttcctcaagtcaagagggctggttcatttgctgtagagttattcactaaactgtttctatcttttacgttcttttctgaatgtgcattatatctcatatatatacagtgtacccaggactacagtatgtaatatagctgcaaatattttggcactcaggaaaggtgataaagggttgcagttatagaagcattcatagaaaaggtgaattttgaacttgcgcccgaataacaaatacccattatatagaataaaacaacagaagccattttcttctaggtgcagaaaagggaaagagagacctttcatggtatagtattaagacttaaatggggttttcattttgctttattttttgagacagggtctcattgtcttgcccaggctggagtacagtggcatgatcgtggctcactgcagccttaacctcctgggctcatgtgatcttaccctctcagcctcctgaatagctgggagtacagggtatgccaccatgcctggctaatttctttcattttttatagtaacagggtcccgctatgttgcccaggctggtcttgaactcctggtcaagcaatcctcccacctcagcctcccaaagtgctggggattacatgcctgaggcactgcgcccggcgacttgattcttttcttttctttttccttttctctgaactttattctgtaaaattttactttaagttccaggatacaagtgcaggacgtgtaggtttgttacataggtatacgtgtgccatggtggtttgctgtactcgtcaacctgtcatctaggttttaagtcccacatgcattccccatccgccaactagccatggtgtgtgttgttgccctccctgtgtcctcattgttcaactcccacttatgagtgagaacatatggtatttggttttccattcctgtgttagtttgctggctgaggatgatggcttccagcttcatccatgtccctgcaaaggacattacttcattcatttttgtggctgcatagtattccatggtgtatatgtaccacattttctttatctagtctatcactgatgggcatttgggttggttccatgtctttgctgttgtacatggtgctgcagtaaacttacatgtgcgtgggtctttatagtagaatgatttatattcctttgggtacatacccagtaatgggattgctgggtcaaatggtattgctggttctagatccttgaggaaccaccatactgtcttccacaatggttgaactaattttcattcccaccgacagtgtaaaagtgttcctatttctccacagcctcgccagcatctattgtttcctgactttttaatatgctttattcttaatagggaggaaagtcattactaagtgaagtcattactgactcttcccaatgcctcacttgatacattcacttaatcaccaaggacagcccattttacctctgcttactcttcaacctttgcaaacagctggaataatcatcttctgtcccccttctccaaagtcacagttccagctgttaccctggggactgttttgttaggtcattaaaggaggaaaaaaccttgcagagtatggtctgagtccgtgtttttctaaaagtaaatgacaaaggatcttgtttgtgcacctcaacagatgtttttgtagcacaggagtctttcacttgaactccatcgggaaaggccaattgacttgaccctcctgcaaagccaagcttcacagagtagtcagggatcctctgaaacagatgaggcaaaacatcctcatcctccccctgcattgaaacccaaactccctaccctgagtggcttttgtctttttttctcccctagcgtaatggactattttggttcctgcaactgaaaagtttaggggtaggtcttgtttcagtcatggctgaatctctgtgctcactcagtggctgttttcctctttttctggcacattccaaacttcttgactcaatagcaacgtggccatgacaggaccacacttactctttcagctgatcccaagaaaagaaactctaccaagagcaccaacgaaagtcccacggatgcgtctagttggccttgcttgggtcatgtgcctggaggttgtactggtgggggaagtagaaatcattactggctacaggtgaggcacatgcccatctctgcaagatgtaatttatgataccttggcttttttgggtaacagctttgagagataattcatataaccacatatcatataatcactcatttaaagtgtacaattcaatggtttatagcctattacgtgttgtacagtcatggccacaatcaattttagaacatttccaacacccaaaaagaaacctcacgctcattagctgctgccactcactccatcccccagaccccggtgacctttaacctactttgtctctgtgattttgctagttctggacacttcatataaatggcatcgtgtgatttgtgatcttttagagttgggctcattcacttagcataatgttttcaaggttcatccaccttgcagcttgttaccttgccttttaaggcccttaaaagattttaaattatctgcctcctgcctgccttttagttctcatgtcatgctgtttttttctcctctgctgggttccactttaagcgtgcagctgcttagacacttttgcagtcaggtaaaggccagaaggtgacatgtagaccaaaggaaaaccgggttagattaagaaataggatctacaggaaatgcagtcattatttcaatgttttgcaataaatcaacagtgtaaagaccaagcactttttaaactgcttgcttcccacacaataaataattgtgttttatctttctttggttaaaataggccctggctcttctgggctaatccaagttgcaaaacttctgccccatgctccctttgggcatgcttgtgagatgccaggttcacattttggtttggaaggtgtagtcaccacatggttgttctctcccctgcatcctccaggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggtaggtcagcccctccacctgcaaaaacttttggggggtctctaggcacggtgatgatgggcaccacgggccaggcttctggaaagccctctgagttgctttcttcagaaatccttggccgggcatggtggctcacaggccaggcatggtggctcatgcctgtaatcccagcactttgggaggctgaggaggttggatcacctgaggtcaggagttcaagaccagcgtgcccaacatggagaaaccctgtctctactaaaaatacaaaaattagctgggcatggtcgtgggcgcctgtaatcccagctacttgggaggctgaggcaggagaatcatttcaacctgggaggcagaggttgcagtgagccgagatcacaccattgcactccagcctgggcaccagagggagactctgtcaaacaaacaaacaaacaaacaaacaaaaaatcctttggcacccttgactctagttctctttgttctagaaattaacctacagtaataccttaggcgcttgccacttcccctaagtagaactgtttcctctagaaggacacttcaatttaatagcgaaaataaatgatgaccactgacttttaaggagtacttattgtgtttccaagaatgggctagtccagcggctctagactgggtcaagatcccccaacagggatgcttgtggttgtgctacaggcatgtaatggggtgcggggcggccggggttgccaagtgtttcataatatgtctaaatcttctaagaaagaatcatccagacaaaaatcctaatagtagccaccaacgagaaactgtgctgcctcccttactcacattattctcattgaatcttcatgtcagcctgcagagtagctcttactctgttttaccattgaggagatttaacctctctgagtctcaacgtcttaccaggaacttggagtctgcctctctgacactcagccctataccatccagctatgaatgactggcaaatgtacagaaagagaaatgttacagagttcagcacgcagcccatttctcatggcccactgctgatggtgaaatctgttttatttcaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 1911 - DNA, 35868 bp, Homo sapiens
tctggtttgaaaaggttctcaagatcacttttaaatgggtgtgatgtgtattttttttaagtagcaggttcattttaaaacaaaaaaggttagtgaagactctgtctttcaaaacataaaaatctgcgataaaaccaattattccatacagtgactacggtcagttctgagaaatgacacccaggttggcgatgtgtctcatggttggccttccatggggacagttccaggggtggtccatctcccccatgtgggtgatcagtttcttcatctcgcttgtgttaagagcagtcccaatcatcacctgagtgtgagacacaatggttcaacgttttagtagttttttgacgtcagaatggcagctcttcagaagcattcttctctaaaataaggctggacaagattacagctcaaaaactaccttccctgaaaaaccttcccccagagaagcctaggttctagatctcagccctccacccttctgtgaaatcaggctccttgtggctccttcaaggtggcaccgcctccactccagacgccgaccacacctgtctcagcagccaccctgccctctcaccctggcaggtgcagcagcctcccagcaggcctccctgccccactgcgacccctccgagccgctctccactcagcagccagtgattacttttaaagggctgtcaggttattcattccacttcacagctctccccctcacctgaataaaagcccccgtctgtcccctgacttggccctcgctgggctgtgcctgcacccccacctccaagcacgaatgcctcccttcctcaccccagctgcactgctactcccttcctcttgcacaggcccatcacgcaaacacctgccttgggactgtggcactcccgggaccctctcccccaatgggtgcaggcgtcactccccctctgtcgagctccgacctgctgcccatagcactccagccctggccctgctgcctccctgccatgggtcctctgacaggaaggagaggacacaagcctgaagcccaatgtcaccttctttcttcctgcagcaccctgagggctcgccatgtgccaagcacagtcagaaggctggggtgacagcaggttggagaaggacagacaatcaacaagtcaacagagaaccaagacaggtggcaccaggcgaggcggcctgctcaggtgtggggatggggtgaagggtgacggtggcaaacccaggtagagaggagagtagggagaaagggtgtaaggcagggaggagactgaggcgagcgtggaactggaaggcagctacatggctggaagctacatggtggggagatggggctggaagggtgggcagggctcaaagcaggagcctcctgggcaggcagtgacaacaccggagatggacgggtaggccagggcgagagggaaggagcagcctgtggttccccgggccactgagtcacactaaactcaggacatcaaaactgcccggctatgagctcagctccacgctctcactcacagactccaagactggaagatccatattatgtcttttattttggtgaggtcaggggtggtggagagactctgtctcccaggctggaatgcaatggtgcgatctcagctcactgcaactccgcctcccagattcaagcaattctcccgcttcagcctcccgagtagctgggattacaggcgcccaccaccatgcccagctaattttcgtacttttagtagggatggggtttcaccatgttggccaagctggtctcaaattcctgacctcaggtgatcaacccacctccgccttccaaagtgctgggattacaggtgtgagccaccacgcccagcccctattaggtctttatccaagaaacactgtggctagaagtcagactctgggccctcttctaattaaactctgcccttgagtcatttcatctaatctcatggctgtaaattacacctgaagctcacacagcaggctccatcccacccactccccacgtggcccccagctgctgctctcctcagcggccgcagccaccgcaccccttccagtctgttctctctccagcagctgcaatcacgggactccttcccgtctgttctctccagtggctcgtgccacacacagcacagacccccagggtctaggtatgaccggcaacactctacgtggctgtcctctggacgccgctctgctcactcccttcccctctccagggacacaatcagcctctggcttcagtcttgctacttccttcgcttggaaagttcttacccaagagggctccattctaccttttttttttttttttttgagacaaggtcttactctgtcacccaggctggagtgcagttgcgtgatgttggctcattgtaacctcgacctccctggctcaagtgatcctcccacctcagcctcctgagtagctgtgactacaggcacatgccaccacacctggctaatcttttaattttttgtacacatggggtctgcctgtgttgcccaggctggtctcttaactcctggcctcaagcaatcctcctgccttggcctcccaaaatgctgggattacacgtgtgagccaccatgcctggcttccatcccaccttttagatggcagctgagatgccacctgcccagatgccattccctgaccaccatctcacctggtcaccatgtttttctcttgtcatttcctgccccaaaacgctgttttaggccaggtgcggtggctcacgcctgtaatcccagcactttgggagaccaaggcgggcagatcatgaggtcaggagatcaacaccagcctgaccaacatggtgaaaccccatctctattaaaaatataaaaattagccaggtgtggtgggtgcctgtagtcccagctacttgggaggctgaggcaggagaatcgcttgaacctgggaggcggaggttgcagtgagctgagatcacatcactgcactccagcctagtaacagagcgagactccgtctcaaaaacagacaaagaaaaatgctgtttgaatctcttgactgtgcttactggcatctaatgcgtgtcatttatttgtggtgatgcctatttctccccactgtctgctccacaggggcaggggctgcagccgccttgttacctctgtgtcccgagcacctggagcagggcgggccccacatcaggggctcaaggagcacctgctgaataaataaaggaatggcgtcctggcccttcccagtggccagctgatacacagtcacttttcttggacatcaggctaatccccactgcaggcagaaccactgctgccaccttcccacaccaaccgaagcagcggcagtgacgccacgtgcaatgacaaccacggcaccccgtgaagcacctgctgcctcgatgactctgcagaatcgtgtccaatgtcgccgagtcctggcagcagcaaatctttatctcccaatgttgttatgacccataaggtccatagacgaacaaggtacctcaaacgctaactgcgttggagtcaaccaaagctcggagatagaatactggccgggccaggcacagtggctcatgcctgtaattccagcactttgggaggctgagacaaggggcaaaaggagaccatgtttctacaaaaaatttaaaaattagctgggcatggtggtgcatgcctgtggtcacaactacttgggagacagagagaggaggatcgcttcagcctggtacgtcaaggctgcagtgagctgtgattgtgccactgcactccagcctgggggacagagggagaatctgtctaaaaaaaaaaaaaagaagaattctgggttttttttgtttttttgagacggagtctcgctctgtcgcccaggttggagtgcagtggtatgaacttggctcactgcaagttccgccttctgggttcacgccattctcctgcctcagcctcccgagtagctgggactataggcgcccgacaccacgcccggctaatttttttgtatttttagtagagacgggctttcaccatgttagccaggatggtctcgatctcctgaactcgtgatccgcccgcctcagcttcccaaagtgctgggattagaggcttgagccaccatgcccggccaagaatactgcttaacagaggtaacaaaagagcaataattatgagttcaaggtcacagagaacgcagacgacacagatgctcagctacgacgctgcacgtagctctctgtgtaaaatgacccctggcaatcacaaaggcgtttacaaccttgaccaaatcaggagctgggctgagaccttcctcgactgcaagcttgagcagctgagctgacagccaggctttctttacttaccgacttccggcaggctctggaggcaaacatctgcttgactcgggaaggccggcacatgaccccagggctgtcgctcagcatgaagatcagttcatcgacgtcctggggtccgaaggtccagtttttactagttggcaaggaaatcagtttagccctttcagtgactggagctaaaagaatacaattttgagaaaaatccatgacttgacaaacacgtttcacttgaaagctacttaggatgaacatctgaggccgggcgtggtggctcacgcctgtaatccctgcactttgggaggctgaggccagcggatcatgaggtcaggagatacagaccatcctggctaacatggtgaaaccccgtctctactaaaaaatagaaaaaattagctgggtgtggtggcaggcacctgtagtcccagctactcgggaggctgaggcaggagaatggtgtgaacctgggaggcggagcttgcagtgagccgagatcggcaccactgcgctccagcctgggcgacagagcaagactccatctcagaaaaaaaaaaagtgaacacctgaaagagaggaaactcacaaaatgctttttggaggaactttttaatcttttataaaattaaaaaaaactggtctatatgacctgaaagattattcccagctctaaaaagacaagaatctatagttctgatttttttttttttttgagacagagtttcactcttgttgcccaggctggagtgcagtgacgtgatctcggctcactgcaacctccacctcccgggttcaagcgattctcccacctcagcctcctgagtagctgggattacaggcacccgccaccacgcccggctactttttgtattttcagtagagatggggtttcaccatgttagccaggctggtctcaaactcctgacctcaggcgatctgcccgccttggcctcccagagtgctgggattacagacgtgagccaccacacccagccgctatagttctaattaataacttaccattttcatcgataacaaaatcaaagccattctttctaaatatttccagattttctatcagaacagcttcattaacagcagttaagttgagagtctgaggtctgaaaaacacaaaaatgattcaaaccatatcctgaagtcaaacatttagctttacagcagaaatgaaatgaaaacaacaatactgtattttgaattcatgtcaaaataacaacacaaataacaacactactcagctaagtgtcacaaaacttcctgagaagttccttttaattttctctttcttaaagttctttttagaagttaaagtagctacaggccaggtgcggtggctcacgcctgtaatctcagcactttaggagcccgaggcaggcagatctcttgaggccaggagtttgagaccggcctggtcaacacagcgaaacactctctctactaaaaatataaaaattaggccaggcatggtggcgcacgcctgtagtcccagctacttgggaggcttaggcatgagattcgtttgaacccaggagggaggcagaggttgtagtgagagccaagatcacgccactgtactccagcctgggcgacacaacaagactctgtctcaaaaaaaaaaaaaaaaaaaaaacacccataaaaacaaaaattagctggaagtggtggctcatgcctgtaatcccagctactcgggaggctgaggcactagaattgcttgaacccaggaggtggaggttgcagtgagccaagatcacaccactgcactccagcctgggcaacagggcaagactctgtctcaaaaaaaaaaaaaaagttcaagtagctacaaaagtagtttgctttttcctcagcctgccacgccaatgactcccactttttctgaatcctttccttaaggataacagtatcacaaaaatgctatttttcctccttctaatacagaatttgaaacactgggttaggtcattgccagcatttgtaaacagaatgaacagacagcttttattttgctatcctgttccttcctctgcctgtattatatctccatccctctctcctcctggatttactgtttgtttttttttaacctttcgttatttttttcaaagatagagacagggtctcactatgttgcccaggctgctctcaaactcctgggctcaagcgatccttccacttcagcctcccaaagtgctgggattacgagtgtgagccactgcatctggtcctgagtgctggataagacaaacactgctcaaggcaggagacagctggtgagcaaacacaggcttggtcctggagccaacagattaccggggaagaaagacgttgagcaaatactcaggcaagtcgattatgatgagaaacgacaggaaggtcaggaagaaaaagcagccagtgtcatagagagacttcaccctggggtcaggaagtgacctttgagctgagtccggggataagagagttaatcaggtaacgggggagaagtgggtgcagggtgcaggacaagtattctagacagggacaacaatctgtgccaagccccaggatggaccgctgatgtttgcagagccacacataaagatatccttcattctgcttagtggccacatagggattcatcaggcctgccaagggaaaaagaaagacagccagagaggcttgagtacagggaacaaggggaagacgaacgggaaaagctacagaggtcaacagggccaccctacacaggggctggcagggcagggtggaactgggtctttatcctttaatcttgaagtgtggtccatctgggaccctaagtggtctgtgattacctgggccaacttgaaatgtcacagatgagaggttatctttgccgaatggctaaaaaatacaagacctcagccgggcatggtggctcacacctgtaatcccagcactttgggaggctgaggttggtggatcacctgaggtcaggagttcaagaccagcctgacaaacatggcaaaactccctatctattaaaaatccaaaaattagccaggtgtggtggcgggtgcctgtaatcccagctactcgggaggctgaggcaggagaatcacttgaacccgagaggcagaggttgcagtaagccgagatcacatcactgcactccagtatgggcgaaagagtgaaactctgtctcaaaaacacaaaaacaaaaaacctctattaagaggaacagggaagggatataaagtagcttactaaatgtctattattaccattgcctcctactgagaataaaaacaattcacgcattccacaggagagtactcagcaaactacacaggagagtactcagcaaactacacaggagagtactcagtaaactacacaggagagtactcagcaaactacacaggttcagtggtacatttctccatgtgggatctacttgttgggatctgagtttacttcactacgtggtttaatttcccacacgaaaatccatgacctcttcttctaactttgctgaagacaagactttggttttacatgatactatcacacctgacctttgtgaagtagtcagggtaaaacattccagtttggccgaggagagagaaataccaaattctgcagtgactatcttaaaataatttttaaattttattttattttatttattaatttatttgtgagacagagtctcactgtctcactctgtcacccaggctggagagctgtgcagtggcacgatcatggcagcctcaatctcctgggctcaaacgatcctcccacctcagcctcccgaatagctgggaccacaggcacacaccatcaagtctgactaattttttacatttgttgtagagacaaggtttcaccatgatgcccaggctggtctcaaactcctaagctcgagggatctgcctgcctcagcctcccaaagctctgggattacaggcgtgtgcccctgcatccaacctgcagtgactatctgacttctgattactctactgtcaatcaacactggcgcacaggctgtctgtctttctgaacacacacattccatacactatgcatactaatactccatactatcaattgccctcatcagaaggatcttctggctaaccagtgatcaacatttttaatagcgaaaaatacctgatacttagagaacatgttaaccacgtgaactggggcaggttactcaacctctctgcatgtgcctcagttttatcgcttgtggaatggtgatggtaacagtaacaaccccataggtttttgaggattaaaggaactaatacacatacattatttcaacagtgcctggcagattctaggcactgaataaatggtaactatcactattatgtaaaaagtataaaaatctgctatatgaatacttatggaaaaatacatatatacatatagacacacatataaactattaggtctctttttttttttgagatagaatctcgctctgtcacccaggctggagtgcagtggtgcgatctcggctcactgcaacctctgtctcccaggttcaagcgattctcctacctcagtctcctgagtagctggaattacaggcgtgcactgccatgcccagctaattttttgtatttttattttttatcattattattattttttgagacggagtttcactcttgttgcccaggctggagtgcgatggcacgaactcggctcgctgcaaactccgcctcccgggttcaagcgattctcctgcctcagcctcccaagtagctgggactacaggcgcccgccaccacgcctggctaattttgtatttttagtagagacaggtctcaccatgttggtcaggctggtctcgaactcccgacctgaagtgatctgcccacctcggcctcccaaagtgccgggattataggcgtgagccaccgtgcctggcctttttgtatttttagtagaggcggggtttcaccacgttggccaggctggtctccaactcctgacctcaggtgatctgcctgcctcggcctcccaaagtgctgggattacaggtgtgaggcaccgcgcctggccaactagatattttttattttttacacccctccttcctagatctcttcttttttaaagtagatacaaggtcttgctgtgttgtccgggctggtctcaaactcctggcctcttgtgatcctcctgccttggcctctattagatcttcaatttgagggggagtctgggaatgaacactaaacacactcacgctatgagcctctgcccctggagcacggtgtgctgctgcagcatctcgaagttatacttctcgtccgtggcatgctggtccactatgaagatatcctcattcagtttggttattataaatcccaggttaaactgaccaatgatttccatttctgcaaacatcgttttactgcaggtagaaaatgttaattatcagacattttacaagattatttttctgattatgttatagaacactgtaataaaaaaaaagtcaaacaatacaaaaacaaaataaagtccctagccatcccgctttctttttttttgaaacagagtctcgttctgtcacccaggctacagtgcaatggcacaatcttggctcactgcaacctccacctcccgggttcgagtgattcttctgcctcagcctcctgagtagctgggattacaggtgcgccaccatgcccagctaatttttgtatttttagtagagacagagttccaccatgttggtcaggctggtctcgaactcctgacctcatgatctgcccgccttggcctcccaaagtgctgggattacaggcgtgagccactgcgttcggcttaaccatcccactttctaaagataacattaattattcattcatccaactctccggagaagacatcagttgctactattaacgatttaaatggaatatatccttctagacccttgtctccatatataattttttttaattttaaaaaacaaaaatggaatcttaattctccattctgtcatcacttaatgcatctgaaacaagttttcagacctgtacacatagatctacttcattattttttctttttttttttcttttaagacggagtctcactctctgttgcccaggctggactgcagtggcgtgaccgtggctcactgcaacctgcgcctcccaggttcgagcgattctcctgcctcagcctcccgagtagctgggactacaggcatgcaccgccaagcccggctaatttttttatttttagtagagacaaggtttcaccatgttggctaggctggtcttgaactcccgacctcaagtgatccacctgcctcggcctcccaaagtgctgggattacaggcgtgagccaccgcacctggcctacttcattctttttaatggccacataggaattcattgcatggatgtaccataatttgtctgacaaatcccctactaaaggacatttcagttgtttccaatttcaatagcgcactcaaagctgcaacaaatacttctgtgcataaacctactcatctgtgggtgcatttccgtgagacagacgctagagggagaactacatatgtacttcttgacgggaaatctgtgaaaagtcacactcccaccaatggtgtgtaagagcacctttctgccaatgctggatatcaatccttctcatctttgccaggcccaccactgggtcctttgcgggtggcttcaacatctaatgtcattaaatactaacttagtcaatctggacaaaagacagacaccaccgctaaccttcacacgagaaattgacactgtcattctcagtcccacacaattaaatccggtgaaaatggattttccgcagtatcagcgcggtgatgacaagaaatggctctgttaaagcagccatggacgttttctggttctcacctggtggcctgagctgaggatgaaagcagctgtaatgtaatcccagcactttgggaagacaaggtgggcagatcatttgaggttgggagttcaagaccagcctggccaacatggtgaaaccccatctctactaaaaataaaaaaattagccaggcatggtggtggacacctgtactcccagctacttgggaaacgaaggcagaagaatcgtttgaacccgggaggcagagcttgcagtgagctgagatcgtgccagtgcactccagcctgggcgaaagagtgagactcttgtctcaaaaaaaaaacaaaggagctgatattgttgtttctttctataagtgctccaggaagacccggtcccatgccaccatgctcgtcaccatcacaatcaaccacaggggacagtttggtgaactgtgagacctccacatggcatggattactgagcccacatttcctatggtgaggggctccacacagagctcaaatccaagtcataaccaaaccagtccccaaatcctatctttgagggtctgtttcctggtaccaattccagatcaggcagagtgcaatcaatcaagagacaaaaaccacaccagtgattttaacagggacttttttttttaagacagggtcttgctctgtcacccaggctggagtgcaatggcatgatcatagctcactgcagcctcaaactcctgggctcaagtgagcctcctgcctcagccccctgagtacctgggactacaggcgtacagcaatgtacttagctaattttttttttttttttttttttttagagatggggcctcattatattgcccaggctggtctcaaactcctagcctcaagtgattctcctgcctcagcctcccaaagtgctggaattacaaggtgtgcaccaccatgttaggcctgaggaggaaaaatgtataataaggcattacacaaactagtaaaaggtggttaactactatgctaagaaatacaggaatggaaaatgctactatcctagggaagagggagagtcctcagaaaaggaactctttttttcttttttctttttcttttttttttttttgagatggagttcgctcttgttgcccaggctggagtgcaatggtgcaatctcggctcaccacaacctccacctcccgggttcaagcaattctcctgcctcagcctcccaagtagctgggattacaggcatgcaccaccatatcccactaattttgcatttttagtagagaaaaggtttctccatgttggtcagcctggtctcgaactcccaacctcaggtgatccacccacctcagcctcccaaagtgctgggattacaggcatgagccaccatgcccagcagaaaaggaactcttgtaagaggctcctacccactcaggctgagtttcagacctccttggagcaggagtggccgcagcctgctggatggagagaagctgccagagtgagtgatgacacaggaactcctgccgcacaggagggaaggaaaagaacatcccagaagcatcccagatgccagcacaaataccacctcccctggcgccgatcccaggctctcccaggaattgtctgaatatgccctggttcccagtacatagataatctgctcaaaagctggtgctggcctaaaagacccaagtcttccatgtgtttggagtctgtgtcctgccacagagaacaggatctggccaggcgcagatgccggaattacaactgcgcactaccgcgcccagccaattttattgtagagacgaggtctccctatgttgtccaggctggtcttgaactcctgggctcaagtgatcctccctccttggcttggcctcccaaagtactgggattacaggtgtgagccaccacacctagcctcaaaatactcttaagaaaaaactttacctggccgggtgtggtggctcacacctgtaatcccagcactttgggaggccaaggtggctggatcacctgaagtcaggagttcgagaccagcccagccaacatggtgaaaccctgtttccaccaaaaatataaaaattagccaggcatggtggcgtgcacctgtaatcccagctactcaggaggctgaggcaggagaaacgcttgaacccgggaggtggaggctgcagtgagccaagatcatgccactgcattccagcctgcgcaacagagcaagactctgtctcaaaaaaataaaaaataaaaataaaaattttagataaaaagagaaaaagtaaaaaattaaaactttaccttatctcttttcttagttcatcttcggctgcttgattttctccaggacaaatctttgccctaaacttcctgtaattctgttccccttcactttgctgtgcttcatgatgtaactgctttattcgtttagctaaagaactcatagaaaagtccaggggcacaactttcttattaattttcacagctacatcaacctgagaggctgacatgtcctgagtatttactaacttttgacaaatgtcagaactggaaagaatttcttcttttttaaaacgctttgtgtttggggttgcgagattagttggctgaggcaaaactcgaaatttacatccggtatcttcctggtttgaatggcagtccacatctgaaaaagagtcgtcagttttaggcgctttctcctgagagtccacatgttcctgcgagcccctgtcccctggggagctggccgcatactcgctgctgcagtgactgcccgtgtctgggatgctgaacccctcagaatccacggaagtgctgccgtgccccgagtccttctccacctccgctctgtccgtagggtcactgggtccgtgactggaactcactgcctctttctgaggtctcaggacgcctttgtcagagatggcacctgaagtgctagaagacagcataccccttttctgtcctagagggctccttcttggttctggagtctttgggctgtgaggcttgttctctgttgtgtgacgaagagaaaaggcctctcgcagtctggaaatggacacgtcttttttttcttctccagtccttaatgaaggggattgatcctgcttttctaccatgggcttttccaaatccgctgcatgcatttttattaagttacctaagcaaacgtggacggagaagagggtcagggactatcctgaaatggtgagaggacgtgcttatgtgaacagatacttcacaaaagaggagatccacatgctaattacacagatgaacacagttcaatgttcaaaataaaactataatatgggccaggtgtggtggcttacgcctgttatcccagcactttaggaggccaaggcagggggatcacatgaggctaggagttcaggactggtctggacaacatggtaaaaccctgtttctactaaaaatacaaaaattagccgggtgtggtggcatatctgtcatcccagctacttgggaggctgaggcacgagaatccctttagcccgggaggcagaggttgcagtgagccaagatgccaccactgctctccagcctgggtgacagagcaacactctgtctcaaaaaaaaaaaaaaaaaaaaaaaaaaccacaacacaatgcaatatggccatatactcaccagaatggtaaaattaaaaaaacaacaaatgctcacaaagatcaggatcaagaggaatgcctgaatacctctggtaggaatgaacctggtacagctgctttgaaaagttctctgggaatacctcctaaatctgaatgtatgcacacctgcaacccagcatagctactcctatcagaagtgcctattggccggcacagtggctcacgcctgtaatcctagccctttgaggtcaggagttcaagaccagcctgaccaacatggtgaaacctcatctctactaaaaatacaaaaaaaaaattagcagggcatagtggaatgcacttataatcccagctactagggagaatgagaatgaggcaggagaatcacttgaacctggaaggcagggttgcagcgagccaagatcactccactgcactccagcctgggcgacagagtgagactccctctcaaaaaaaagaaagaagtgcctatctatgctcgtcaaaaagacgtggatgaggatgttcatgacagcattcttcattatagccccaaactggaaacaattcaaatattcacaaatgatgatatctgactataatggaacactgtatagcgaacgaataaatgaattttgccacatgacttgggtgaatctcacaaacaaaataatgagagaaagaaacaaatcacagaaaaggacagactgaataacttcaaattaaaaacagattaaactataccgttttgggttttttttgtttgtttgtctgtttttttgagacggagtctcgctttgtcacccaggctggagtgcagtggcacaatcttggctcactgcaagcccctcctcccgggttcacgccattctcctgagtcagcctcctgagtagctgggactacaggcgcccgccaccacgcccggctaattttttgtatttttagtagagacagagtttcaccgtgttagatagtctcgatctcctgacctcgtgagccgcccgccttggcctcccaaagtactgggattacaagcatgagccgctgcgcctggcctaaattctactgttagaagtcaggaaatcccagcattttcagaggccaaggctagaggactgcttgagctcaagagtttgagaccagcctgggcatcatggagaaaccccatctctaatgacaatacaaacattagccaggtgtggtggtgggcgcctgtaatcccagctactcaggaggctgaggcaggagaatctcttgaacgtgggaggcttcaaggttgcagtgagctgagatcgcatcattgcactccagcctgggtgacaagagcgaaactccatctcaaaaaaacagacatgacaagggagttaaaaatgcagtcactgcagacttcttctaatcatatatcttatatgacttcatccgtttacagtttacaaaaaactagaggtacttggaggcagctacttgggaggctgaggcaggaagatggcctgagcccaggagtgtgatgctgcagtgagctacaatggcaccactgcagtccagcctgggtgacagagcaagtccctgtctcaaaaaagaattaaaaatgataaaataatataagagactttgttttcatgtcaaaaaaaagtttacttggaaaaaataaggaaacacattagctaaaagctttagaagctgtttgtacactgtatttttcttaccttcaacatccagcagtggctgctgactgacatttagcttgttgacatcactatcaaacattcctatcaaagaggtctttaaaactgccaacaaaagcttttcctcttgtagcaaaatttgccttttatctggagtaacattgatatcaacgcattctaaggcaaaaaagaaaacatatttattatgtttaaattcacttttattttatttattaattattattttcagacagcgtctcactctgtcgcctaggctggagtgcagtggcgcgatctcagctcactgcaacctccgcctcctgggttcaagtgattctccctgcctcagcctccgaagtagctaggattacaggcaagtgccaccacactggctaatttttgtatttttagtagagatggggtttcaccgtgttggccaggctggtctcgaactcacaacctcaagtgatccacccgccttggcctcccaaagttctgggattacaggcgtgagccaccgcgcccagccaaattcacttttaacaatagaaatttccccatctattatttcattcacttgtatttatcacaagtgctattaaaaacattacagtgtccaggttaagattcataagttatgaaatcagctttttcaaataaatgagcaaaagacaatttttgaatagacaaaatacggaagggcttaattaggtaaattgttaaaggaaaagcaaataaacacataaaaataattttaaatatgcaaactaaaataagatattttaatcccctactgaatttagcttaacaattataatacctagtacattataggtaggtgtgtaaattggtacatctagaacacaatacagaaaaagccttaaaatgatcatattcactgacccagtaattctactcccggcaatttatattcagaataattaaagatgtaggctgagtgcagtggctcacaccctgtaatcccagcactttgggaggctgagacgaacagataagttaaggtcaggagttcaagaccagcctggccaacatggcgaaaccccgtctctactaaaaacacaaaaaattagtcaggcatggtggcaggtgcctgtaatccgtgctactcaggaggctgaggcgggagaatcgcttgaactcaggaatcggaggttacagtgagctgatattacaccactgcactccagcttgggagacagagcaagactctgtctcaaaaaatatctaataataaagatgcagataatgatttaattataaggaaagtatttataatttccaaaaactaaaaacaatttaattttgaaaaatttaaaaattaaaataccaaactataaccatgcattggaatataattcacctattaaaaccacatttctgatcaatttctaataacatggaaaagaaaacattcacatctaaggataaagagcagtatacaaaattattttctcatcccaaagaatatgggagtaggggagagagagagaaagagagagaggacagaagatattttttaaggtatgtacatatgtgtttctaagtatctagaaaaaatactcaattacaataaaccaaaattttaacaatcagaaaaaaaaatctatatgaaatgaattatttatgaaattaggaagaacatttcatctactttctcccttggttgacattaaaaaaaattacattttcctaacaatataattaacatagtctcaagtagaaagcgggaactctgtttaaaaaaaaaaaaaattatagggccaggcacggtggctcatgcctgtaatcccagcactttgggaggccaagacgggcagatcacgaggtcaggagatcgagaccatcctggctaacacggtgaaaccctgtctctactaaaaatacaaaaaattagccaggtgtggtggcacgcacctgtagtcccagctacttgggaggctgagtcaggagaatcgcttgaacccgggaggcagaggttgcagtgagccgagatcacgccaccacactccagcctgggtgacagagcaagaccccgtctcaaaaaaaaacaaaaacaaaaaacttacatgaccataaattgttatctcattccagtcatagcagagctgtagaatttcattttattctttgaggcattagtcactagttgtactgaaatgccaatggaacttacctgaatcaacagaaatgttaagaacaacaaatggatactggtgtcgattatacatgtggtagacctcattcacgagtctgcagacctgcacaaaatacaaggagtagaaaagaataaatgacaaatgttcccagccccccgcattctaacaacattctattctaaccaaccagcatgttcttagaaggggatacttttttgttttttttttttttgagtcaaggtctcgccttgtcacagcctggagtgcagtggagcaatcatggctcactgcagcctcaacctcccaggctcaagtgatcctcctgtgtcagcctgacatgtaacttggattacaggcaggatttttttttctttttttttttcaacggagtctcgctcttgttacccagactggagtgtaatggcacgatcttggctcactgcaacctctgcctccggggctcaagtgattatcctgactcagcctccagagtagctgggattacaggcacacgccaccatgaccagataatttttgtgtttttagtagagatggggtttcaccatgttggccaggctggtctcgaactcctgacctcagttgatccgcccgcctcaacctcccaaagtgctgggattataggcgtaagccactacacctggcctaaggatacatttttttaacagctttactgagatatgactaacatggaataaactacacatatttaaagtgtgcaatttcataagttttgacatatacacaaacacctgtgaaactatccccacaatcaagataatgaatatatccatcaccaaaagtttcctcacaatctcaaagtgatatttctctaatcatagattcctaaaactgaatatttttccaacttaaagttgctctatgagaaattctagtgaaatgcaagtgcagcttaaatgttcataaaacatattcaatgtacatagaaaagtatctatgacattaaaatgtcattagaaataaaccaaaatatcacattattaatagttataattaataattatgaatccatcacactataggttaaaaaatttagaagttcaaccacatctggcagattacaagcaaactctaaagcatcattgaaaaacaggggctgggagcggtggctcacgcctgtaatcccagcactttgggaggtcaaggcaggtggattgcctgagctcaggagttcttgactagcctgggcaacacagtgaaaccccatctctactcaaatacaaaaaattagccaggcatggcagcatgtgcctataatcccagctacttgagaggctgaggcaggagaattgcttgaacctgggagggagagcttgcagtgagccaagatcacgtcactgcactctagcctgggcgacagagctagactccgtctcaaaaaaaaaaaaaaaaaaaagaaagaaagaaaaaaaaacaaaatattactgaggtacaatgtgttgctaagatacaaactcaaaaaacccatgtcatcatatcaagatgatcaatttaaatctgaggcagaagtaatctgagcccttattttcctaggaaaatagaaagaagagaaaatatagaaatctatagaaaatatagaaaccatgggccgggcgcggtggctcatgcctgtaatcccagcactttgggagacagaggcgggtggatcacgaggtcaggagttcgagaccagcctggccaatgtggtgaaaccccgtatctactaaaaatacaaaaattagccgggtgtggtgatgcgtgcctgtagtcctagctactagagaggctggggcaggagaatggcgtgaacctgggaggcggtgcttgcagtgagcagagatcatgccactgcactccagcctgggggtgacagagcgagactctgtctcaaaaaaaaaaaaaaaaaaaaaaaaaggaaatatagaaaccatgtaatcagtctatactgaaaggtgacatagaatgttataaaatgtttagtttcttcaaatagttttagtttttacaataataaatatactggtaatatgtgtttatatatttatgtatctatacacacaacacatataatgtatatatgcagatacaaacacactcacgtatatgcaatttaaaaaactatacagaggccaggcgcggtggttcacgcctgtaatcccagcacttcgggaggccaaggcaggcagatcacgaggtcaggatttcaagaccatcctggccacatggtgaaattccgtctctactaaagacacaaaaacttagccgggcgtggtggcgcgcgcctgtaatcccagctacttgggaggctgaggcaggagaatcgcttgaactcgggaggtggaggttgcagtgagccaaaatcgcaccattgcactccagactggccaacagggcgagactccatctcaaaaaaaaacccaaaaaacaacaacaaaaaaaactgtacacagatagatgcgctccttaacttatgatagggttatgtcctgataaacccataagttaaaaatattgtatctgctgggcgcggtggctcacacctgtaattccagcactttgggaggccgaggtgggcggatcacgaggtcaggagatcaaaaccatcctggctaacaaggtgaaaccccgtctctactaaaaatacaaaaaaaaattaaccaggcgtggtggcaggcacctgtagtcccagctactcgggaggctgaggcaggagaatggcgtgaacctgggaggcggagcttgcagtgagccgagaccacgccactgcactccagcctgggtgacaaacaagactccgtctcagaaaaaaaaaaagaaagaaaagaaaatactgtatgtcaaaaatgcctttgtgataacctaacctactgaatgtcccatctcagccttgcctcagaatacttacatagtctataggcaaaataacctattttataataaaatgttgaatatcttctgtaatttattgaatactataccgaaaaacaatggttcaataggtacttgaagtatggtatctactgcaaaaaataacttctgcaacaaggtaaagtagtagaaaaaaatatatatatatttttttgaaacacagtctcgctctgtcacccaggctggagtgcagtggcataatctcggcttactgcaagctccatctcccaggttcaagtgatcctcctgcctcagcctcccatgtagctgggattacaggcgtggaacaccatgcctggttattttttgtattttagtagagacggggttttgtcatgttggccaggctggtctcgaactcctggcctcaggcaatccacccgcctcggcctcccaaagtgctgggattacaggcatgagccactgcgcccggacagaaaagtcttcagttgaaacatctgaagctgggggccatctgcggtagacttctgtaaatgcacaaaataagataatgttaaagccatgtttctcaaagtcccgagctccacgtaaactgcctattatcagaaaaaagttatcaattaaaagtcaaaggcataaagaacaaactaacacaaaaaaattttaaatacctttgctgggtcacaaggccgccggttgataaagaaaaactgtctgtctgttgaactccttccaactccatgcgtgcattgtgaaatgaaacctgagatgctattcaacattaatatggtaagggcaggattccagagtgaaagggattagaaatacgatcacatggcacattcttaaagtgaaatgaaaacaaaacaccaggtgacatgctgataaggatcactattgcagttcacgggtatctgtgctccaaatcttgatgagtcatcaaagaaccaaaccttctggaatattctaaagctcctacagtcaaccaatgcaccacaggtgatgcagtgcgtccaaaactgatgtgttgcagctctccttacccttcctgataaatcctcagcctctgtaagtgggtctcgcttcaaatgcattctcagaacctccgtgctgccacccctggtttgtcaatgaagtctaaccacttgtgctcagaattttgcccacattccctcccctttcaaaacctcccgggtaggacgcttatatctcatgtcttggtaaagcgcttgcttcacatgagacccaccccagggataccggcatttccagaagaacaccaccttcacataaagacataaagctccatgtttaccatttcaggcataagccaaaagcaagtggaggaagagtaagaaatatagatctcaaggcaacaaacaaacaaacaaaaagaaatacagatcttaggctgggtgtggtggctcatgcctgtaattccagagccttgagaggccaaggtgggtggatcacctgaggtcaggagttcaagaccagcctgggcaacatggcgaaaccccgtctccactaaaaatacaaaaaatcagccgggcatggtggtgaacacctgtagtcccagcttctcggaaggctgaggcaggagtatcgcttgaacctgggaggcagaggttgcagggaggcagaggttgcagtgagccaagatcacggcactgcactgcagcctaggcaacaaagcaagactccatctcaaagctaaaaaaaaaaaaaatatatatatatatatatatatacacacagatagatagatatctttacaggaccaatcctatttatggaagtgtctattttcttatacgaaaagtaatgacactgaactgccttcatcagatgccaggaaagtcaaaatcatttaaaatgataaaataatttacaagttagtctaactaaacagagccttaaagaagacctgctcaacagaaaaccacctgaaatataccacttactcaaaacatggtttgaattaagcaactgactcctttgtataaatcatctttcttagccacagcattgctcacagttttataaaggacataaaaaactattatccctagccaggcgtggtggctcatgcctgtaatcccagcactttgggacaccaaggtgggcggatcatctgaggtcaggagttcgagaccagcctggccaacatggtgaaaccccgtctctactaaaaatacaaaattagccgggtgtggtggcacgtgcctgtaatcccagctactcaggaggctgaggcaggagaattgcttgaactcaggaggtagaggttgcagtgagccaagatagcaccattgcactccagcctgggcaacaaagcaagactccgtctcaagaaaaaaaaaaaaagacacgaaactattagccttagaatcactatctttaaaaaaaaagctctcaggataaaatgttcaattgtagttctcttgccagcaatctacttactaaaaaagattatgcagagcatcggaacagctcaaaccgtactcttcacacacggagtcactagggggcagctgaacaaaaggaatgaggctttgcaactgaaaaaaaaaaaaaaaaattcacagttacttcctaataaagacagagtggacttaatctgttttctttcttagtcaagctattgacattacaagcgcaaaaaaaattaaaagaatcttttgttttgttttgttttttgagacagggtctccctctattgcccaggctggagtacaatggctcaatcatacctcactgcaatgtcaaactcgtgggttcaagcaatcctcctgcgtcagcctgtcgagtgagtagctgggactacaggtgcacaccaccacacctggctaattttttaatttttttgtagagatgggatcttgccgtgttatccaagctggtcttaaattcctgggctcaagcgattctcccacctcaaaattgttggccgggtggttcaaacacataatcccaacagtttcctctcccagagtgctgggattacatgtgtgagccgtgggaacaacaattttgattttatgatataagaaagatgaaacaagtacctacttattcagaacccacacattgcccacaataacttatatttttttcagagagagagtgaaaagacgcagtatacgagtgtctctggaagaataaaatgaaacacattcagctctcaaacatcaatttttgtgataggtactttgtttttttttttttttttttcctgggatggtgtcttgctctctcgcccaggctgcagtgcagtggtgcaatctcagctcactgcaacctccatctcccgggttccagcgactctcctgcctcagcctcctgagtagctgggattacaggtgcctgccaccacgaacagataatttttgtatttttagtagagatggggtttcaccatattgatcaggctggtctcaaactcctgacctcgtgatccgcccacctcagcctcccaaagtgctgggattacagacgtgagccactgcgccgggccttgtgataggcactttaaaaatcaattcttaatctgggcgcagtggctcacgtctgtaatcccagcactttgggaggccgaggcaggcggatcactagaggtcaggagttcgaggccagtctggccaacaagatgaaaccccatctctactaaaaatacaaaaaattagctgggcctggtggcatgtgcctgtaatcccagctactcaggaggctaaggtaggagaattgcttcaacgcgggaggcagaggttgcagtgagccaagatggcgccactgcactccaacctgggcaacagagcaagactccagctcaaaaaaaaaaaaaaccggccgggcttggtggctcacacctgtaatcccagcactttgggaggccgaggctggtggatcacgaggtcaggaattcgagaccagcctggccaacacggtgaaaccccgtctctactaaagatacaaaaaattagcctggcgtagtggagcatgcttgtaatcccactactcgggaggctgaggcaggagaattgcttgaatctgggaggcggaggttgcagtgagccaagacaacaccactgcactccagcctgggcagcagtgcgagactccctctcaaaaaaaaaaaaaaaatcaattctaagattttattctccattctactggaagggacaatggaaacccgctataatcactagagcaataagaggcgttgaagtaaccggccatcactacctgcttctgcccaaacacagagccgatattttcctttatgctggggcttccacctgtgcataccacaggctgtcgttttccttgtccaagctgattggtgcaacttacacggatgcctgctgaaatgatacagtatgcatgtaagacctggaccattttggcatactcctgtttaaaaaacacaaacacaatattctacattactttaatattataggaattacacagctcaagttacaacatccaacgcaaggttctcacatcatcgcacaaatcaagggaagcactgttgacagaatgatctgtaaagaggtgtcttcctatattctacagaaaggaacgcagagcttttggctcctggtcacagtcctctcacttcccaatgtgccatgcatcctggtaaaacaactaaaaagtacagcctgtaatcccagctactcaggaggctgagggcaggaggatcacttgagaccaggagttcaagaccagcctgggcaacacagcaagaccctgtctctacaaaaaatttaaaaaaaaaattagccgggcgtcatggcatgtgcctgtagtcacagctactgaggaggctgaggtgggaggatcgcttgagcctaggagttcaaggctgcagtgagccatgattgcaccactgcactccagcctcggtgacagagtgaggccctatctctaaaaatgaaaattaaaaaactgaaacgtacattgtgtttgattttataatctctccttttgaaatgtatcttcgtataatagaaacactggcacaagcattttggtatgcaaagagatacacaaaaatgttcactgaaacaatctctatgaacaaacagaaacaacctaagcaagcatcattgaggagttgattaattatggtatagccatagcgcagcagaatgacaacaaataaggcagtgtgcaccgactaaaaaagacaatcacaatatgctaagtaaaaagtcagttatagggccaggcatgatggttcacacctgtaatcccagcactttgggaggctgaggcgggaggatcacttgagcccacgagttcgagacctgcctgggcaacacagaaggacccatctctacaaaaaaaacaaaaattagccgggcatggtagcacgggcctggagtcccagctacttgggaggctgaagtgggaagattcattgagcctgggagatcatggctgcggtaagctgagattgtgccactacatcccagcctaggtgagagagcaagaccctgtctcaattaaaaaaaaaaaaaaaaaaaaaatacaactttcaaccacatacaattctgtattacttgcatgttgtacattctatattacttgctttcattatattaacttatgaatttatcttgaaaattattccaacagttataaacacatgaaattaaaagcagcctgaaaagatatacaaactgtaaataacagttatctctgacaaatagaagttctacattcctgtattctgctaaggcactaatttttttaccataagatacaaaaaaagagtaagttttctctactttagaaaatttaaatttgtgaaaaaatgtaataaagttaaaattagcagccaagtgcagtggctcacacctgtaatcccagcactttgggaggctgaggcaggtggatcacttgaggtcaggggtgcaagaccaggctagccaacatggtgaaactccatctctactaaaaatacaaaaattagctgggcgtggtggcgcacacctataatcccagctactcgagaggctgaggcaggagaatcacttgaacccaggaggtggaggttgcagtgagccgagatcgcaccactgcactccagcctgggcgacagagtgagaagactccatctaaaaaaaaagaaagttaaaattagcaccaaatgctttacaagtaaaaaaagtttttagctgcatatgtttaagtaactttttagattatgaaaaacacacatacaaaatgggaaggcacaaagaagacagcaaaaactgcatgagatctcacatccaaggataactgctgagaacatgaaagtgccgagtcttccagcctttatactatacacatttaggcttgttgttttgttttcacaaaattgtaatcaaataatacagacagttctataatctgctttttaaacacaacgactatataacatttagctattttcatttgcattcaaattcataagggttctaatagctcatttctcagaaaaccaagagaaatattcttttttttttttttttgagatggggtctggctctgtgcccaggctggagtgcaatagcttgatctcggctcaccgcaacctctgcctcccggattccagcgattctcctgcctcagcctcccaaggagctgggactacaggcacatgccaccatgcccagctaatttttgtatttttagtagagatggggtttcaccagtttggccaggatggctttgatctcttgacctcgtgatccacccgcctcagcctcccaaagtgctgggattacaggtgtgagccactgtgcctggccgagaaatattcttattaaaatataagtacataaggccaggcatggtggctcaggcctgtaatcccagcactttgagaggccaaggtgggcagatcacctgaggtcaggaattcgagaccagcctggccagcctggacaacatggtgaaaccccgtctctactaaaaatacaaaaattagccagctgtggtggtacacgcctgtaattgcagctactcagaaggctgaggcaggagaatcgcttgaactcaggaggtggaggttgcagtgaaccaagatcgcgccaccgcactccagccagggcgccaaagagaaactccatctcaaaaaaagataaaaataaaaaataaaaaatatatatatatgtatatatatttttccagacaggatcttattctgtctcccagtcttaagtgcagtggcgcaatcatagctcactgcagcctcaagttcctgggctcaagtgatcctcccacttcagcctcccaagtagctggaactacaggtacatgtcaccatgcccagtaaatttttttttaaaatttttcatagagacagggtctcactgtgttgcccagtcctaataaacactatgtgatgaaaagaaaaaagtaaatcatcctaaagttaagtctttaatgttaaatctttaatgagaaatgcaaataaagcatttctcaataatttatgggaagagaatcaactgaagaataaacatctttagtaaatcttttgctcatgtgcattaaccaatactcttgaaaaccaggattaatttactgtaccttcttaatattcctttgaaattccttatggcgcacaggtagtgtggaaaataactgctgcacgctgactgtggtccctctggggcgggggtagggggttttctggataattttcccattgtgatcaaacatcagtcgagttccaaccttcgccgatgcgtggcaggtagaaatggtgacatcgctgtgagagaataccaggcatggtgtgttcagtgagagacccatgatgttgggcactgactactcttttcttcacttgcttttctctcaaaattttcttaaaaagctgacgatccctctgagataatcaagatctaaatggttgaggagtcatcataaaatctaaggtttggcatctaaaagacagtgagacagagagcactaaacatgctttgctttgataaaagctttgatttcgtttttcaggttgaactgcaaaaccataaatgatcttaagatttatttattcacaaacacagatttgttttgttattactcttcgaacaaattttttttaaagaatctaacaaatattataattaaaatgtatatgtagggcagagcgtggtggctcatgcctgttatcccagcactttgggaggccaaggcaggcagatcacttgaggccaggagtttgagaccagcctaggcaacatggtgaaatcccatctctactaaaaatacaaaaattagccaggagtggtggtgcatgcctatagtaccagctcctcaggaggctcaggcacgagaatcacttgaacctggaaggcagagattgcagtgagccgagactgtgccactgcactccagcctgggtgacaaagagagactctgtctaaaaaaaaaaaaagatatatatatatatatataattatttataaaaatttcatatctgtgctataattaaatagtgctttggtgaaatgtttccctaaaaattgataatgaaaaccaatggtaactatcatttattatctacatgttaggttaaaattgagaattactgttttaataagggtaaccatctttttaacaatactatttgcttcatttcattcatttattgctcacatttcagaagtactatgacttagattggcagcgagacaaaacagaattcagaagctagaagttgagatgttgagatagaaaactgaaaataataatgattccaattaattttcagagaggtttctctaaggggtcaagtgagtggataaaaatattgtatcacctcagtgcacaaagtgagctcagagcttccccccgaaagccaaaagtttcaacctgagttaggtcggcaaactcttgaatcttagatgtgtgatgtttcagagctgaaagagagtgtaaagtaaggactaagatatctcaagtgctataacaacaaaatatacatgatatctagtaactggctttaaaaaactgtttttgcatttcccaagacagtgttactcaaaattctgagacatgtgacccaattattttataataggattagaaaaagtcaacttacttaagccttcgaagttttcttcttctaccccacatccattgtctgaaacttcaataagatccactccatagtccttaagctttagatctagaaagtttaaaatatttacatatttattaaaaacggacccatgctatcagtttttatattgacattatttataacatatgcaaatttaagagtcataactatacctttagttaaacatactagtgtcattttgtatatttcattgttataaagtcctttctggctatttactagcccagactaaatagtttagctttttctttctttcctctttttttttccctaggctagtgaagtgaagcagttggagtggagaaggaacaaaaaaaatctgtaactggtggtgatcaattagctgtaaaccgcgttgcactttgaccatccttttcttttgaaagaaataattttaacatacccaataaagagaacggggaccgggtgcagtggttcatgcctgtaattccagcactttgggaggccaaagcgagcagatcacctgaggtcaggagttcgagaccagcctgaccaacatggagaaaccctgtctctactaaaaatacaaaattagccaggcttggtggcgcatgcctgtcatcccagctactcaggaagctgaggcaggagaatcacttgaacccaggaggtggaggttgcagtgagccgagatcgtgccattgcactatagcctgggcaacaagagcaaaactctatctcaaaaaaaaaaaaaaaaagagaatgggttctggaatcagacttcctggatcctattttatcagctttataatctcaaaaaaaggaaatttcctatcccctaatttcctcatttgtaaaatagagaataataagttctatctcataaagttattctgcagattaataattctttggttttttttattttattattcttttcttttcttttgagatggagttttgctcgtcacccaggctggagtgcagtggtacgatcttggctcactgcagcctccacctcccaggttcaagcaattctcctccttcagcgtcctgaggagctgagattacagccatgcaccaccacatctggctaatttttgtatttttagtagagacagggtttcatcatgttggttaggctggtctagaactcctgacctcaaatgatcagcccccctcagcctcccaaagtgctggtattacagatgtgagccactactccagccctattttgttttatgtttttgagatggaatcttgctctgtccccaggctggcatgcagtggcacgatctcggcttactgcaacctccgtctctcggcttcaagcaattctcgtgcctcagtgtcccaagtagctgggattacaggcttctgccaccaggtccagctaatttttgtatttttagtagagacagagtttcaccactttggacaggctggtctcgaactcctgacctcaggtatccacccgccttggcctcccaaagtgctgggattacaggcgtgagccactatgcctggcctactttatttttcaatagagacaaggtctcaccatgttggccaggttggtcttgaactcttggcctcaagcaattcccccacctcggcctctcaaagggctaggattataggcgtgagacaccacgcccagctgttctgcaaattaaatatttctgtgcaattcttagcataacacctgcctggcacaccgtaagaacacaataaaagctgttattattattactacctagctaagtactaggcacataataggtgctaacttcaacttaaaaataataatttattactacatcaacacttgatagtcttatttcaataacaaatgtttcttaactacaacaacattcacagatcatttcttgtggcttaaaactctcccaaacttaccaatattagtggcaccagcatccagactgttttctactaactcctttaccgcagtgcttagactcagtaccacctgcccagagcaaatctgatggactgacttccgatcaataggtttgatggccttagcaggttctgtactagagaaatcagttacaagaaacaaatcaagtattcagctatatattttcatcctgattttaactgtgggaaatgactcaacactgtaaataatttatgggtctaatctattcatttattatattagcaaatacatttattatatccagaaatagaaacactgttttacaatccttaaacatgtacccaaaatacttctggatagatacttcaaattcaacagatccttactatctaattatactaagatccacatggagaaaacatacattgtatctctcaaattaccaaaatctttggcaacaatggtgtcttctttcttgaaaagtgaaagcatggctggctgtggtggctcatgcctgtaatcccagcactttgggaagcagagatgggtggataacttgaggtcaggagttcgacaccagcctggccaacacggtgaaaccccgtctttactaaaaatacaaaaaattagccaggcatggtggtgggcacctgtaatcctagctactcaggaggctgaggcaggagaatcgcttaaatccaggaggcggaggttgcagtgagctgagattgcggcattgcactccagcctgggcaacgagcaaaaaaaaaaatgaaagtaacataatttcccaacataattagaaaaaccaacagtatgctgggaaatacacaatgtttaagtcaaaatcatctcagaaattgggtaccagttatataactattccttatacacagttgcctttgataccccactccaaactgaagctgccagctgctgtcttagcaaagaccctcaaagctcttgctgtactagctttaagagttttataaaggttttatctccccttattccctgctccaatacatcctccactctatcaccagagctatttttgaaatcacaaatctggtcaaataatttttctgcttaaaaatttactagtgccccacttcctactatatgaaagttaaaatttagtcatcattggggccaaaactaccttcttttcagaatctctctaatcctttcccttcatcaagtcccctacattattattattattattattattattgttattattgttattatttgagacagagtctcaccccgttgcctatgctagagggcaatggcatgagctcagctcactgcaacctccgcctcccaggttcaagcgattctcctatctcagcctcccaagtagctgggattacaggcgcccaccatcacacccagctaatttttgtgtttttagaagagatagggtttcaccatgttggccaggctggtctcgaactcctgacctcaggtgatccgcctgcctcggcctcccaaagtgctaggattacaggggaccgcaaccagccatcccctatattgtagcacagtgaacaactgtcctgaacatcacaagctctttgagacactacagtgtataagcaggtctctgtctaaaccgctctcctcttcctcctctgcccaaacaatgtctgctcaaagaatgtatcccgtgtgttcattaacttagcaatttccagcaaacagtttaattgataacttgttaagagaaggcaggaaacctccatgaaagagaaatcactgggtatttcctacagcatttaacacatcgtaggcctttaataaacccttctgaaataaacaaacctctttactcttcattccaccttgctaagaatctcacctaagtctgtctaccatgtgaaactgcagatgacctcacagaaaatggaaagaagtatctctaaaaataagtttatttggcagcacactataggctacaggtccacttctgatttttttttttttttttttttgagaccgagtcttgctgcgttgcccaggccggactgcagtggcacgatctcagctcactgcaacctccgcctcctgggttccagcgattctcctgcctcagcctccaaagtagctaggattacaggctcccgccatcatgcccagttaatttttgtatttttagtagaaacggatttcaccatgttggccaggctggtcatgaactcctgacttcatgatccacccgccttggcctcccaaagtgctgggattataggcgtgagtcaccgctctcggcccacttcagatatttattttgaggagggagcgcatttagacacagaccccaaatttatttaaatgtctcaatacatttaaatgtagttacctaaatatatctaatatatttaaatgcagagagcaaatttgcgtttacaaatctgacatggaatgcaaatgtgctagccaagattcggtgtagcttaccagccagaaatcacacatcctaacaggtagaaacgtattgcatttttaaaaactgcgcagctatgcaaataaggatgtgtctggacgctctaccgtccccaaaataaccttaattttttaaaaaggccaggcacggtgcatcatgcctttaattccagcactttgaggggccaaggcgggcggattgcttgagctcaggcgttcgagaccagcctgggcaacgcagcgaaatccccgtctctacaaaaaaaaattaaaaataaaatactataaaaataaaaataaaaggggagagagaacaggtagaaaggaaatgcattcagtctatggggatttcacgctcccgcttcaagtccacggccctgtgatgggatgtgggcaaggcctgtctgggacaggccgaacccaactcctcacagggccgaatcctttgcccgcagcccaggaccccgaaggagcttgcctcggcctcaaggcgcacccaaggggcacgagatcgctgcaacactgaggtcgccactccggggcctccagggggctgcctcgccacgcgcctcggccatgttccccccatttccagggaggttggaatgccgtgggtctcaaagagggcgcgcgagaggggacaccggaagactgcgagccccgctcacctcgagctctcagctcgctccatggatgcaacacccgatccgcctcggggactgggaaagttccctccagggctcccacaggcgctccgcctcctgaactcccattggct

SEQ ID NO: 1912 - DNA, 8628 bp, Homo sapiens
ataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacgggtgaggagggcaccaggcccgcaggacccttggggaggggcaggtgctgtgacccgggaacctggcacactgggcccagagggagctggcggagggagcgagcgcccaggggatgcagagaggcctggcactgagcctagtgtcgggagcaaggcggcagagtcatgcggcagccagcgcgggcagggacgcacgcgggaatcgagctggggtggcgccaccggagcaggaaggggacaggtcggtgcggtctaagctactccgtaaaagcagccgttgtgtgtctccgtgtgtgtgttaggggaacaagtggagagtgagtatatgtatatatccctcactccataccaggaggaggtctcctcaccccctgcgctcttcataaattcccatgctagggtctgggtaaagctgcgaggtacttttggtgctcaaattcggagttcctcctttagaggcaagattactcacctcctttgccagttgcactcctcccttccttccagactggcagtatgattaactcggtgggaagtgactgctaagtggagacggaaatcagtcaccgaactgagcaacagtcctgtgctcacttcccccaccccacgcctttgaaaactcttctctcggcttgggtcctggatatcccagtccaagtgacctgcattaggcatcacagttgcttttggatgcccagggagccagggtgttcttgaggggactgatagccaatgaggaagtgctgtgagatgtggctagacatgccatgtggcggcagcttcacacattcatttcctttgcaccttttggggatgccatttgattaacattttaccagcttaattgcttctctccattgtcctgtggctccgttgaccagcccccaacctacctgatccaactgcttccctgagggtagcctggtgtattgtgcaatcatgtctggtttcccgggctctgctttccaagtaaaaaatttcctgtgaaagcttggttagttgtgttcagctctgtcacacctcattgccacctctgaaagcaacgtttggtcttcccagatggatgtgagagaactggacttggaactgggagaaaagtaacacgggttgattcttgctagtgtaggggttctgggtaagtgccctgaggtttctgaagagcaaagatcctcggtggagagaaaggaaactgggaggaggcagggagggggaaggacaggaagaagaccacaggcaggtggaaagcaggagaaagattcaaatactttgtgtaacagagccataggtctttggaagttgttagcaagtattcaattcattttcagattgagcctataagatagatggggccaatttacatcccttgtttatacctgagaaaataatttaaagcacaaattacatgcctaaaaagacaatattgggactagaatctaggtcgaattctgcttccctccagaccagcaattcctaaacctggttttattttattttatttttatttatttattttggagtcggagtctcgctctgtctcccaggctggagttcagtggagcgatcttggctcactgcaacctctgcctcccgggttcacaccattctactgcctcagcctcccgtgtagctaggactacaggggcccgccaccacgcccggctaatttttttttttttttttttttttttgtatttttagtagagacggggtttcaacatgttagccaggatggtctcgatctcctgacctcgtgatccgcccacctcggcctcccaaagtgctggggttacaggcatgagccaccgcgcccagcccctaaacctggttttaaaatcaaaattacatgggcttcagaatctgttttttgtgggggttttgtgtgtgtgtgtgtgtgtgttttttatagggtctcactctgtcaccaggctggagtgccagaatctgtttttctaacaagcttctgctgagaatttgtgtagtcagtcctggtttaacctttgacaaccagtactgtggactgggtctgcttttttgtacagcagtttatctagttttttgtctggaattaacccccttgtgatccagggagctaagaatggcacgtagacctctaccaggggtggtcccattgtgttttattggttaaaacaaaaaagaaatgtagcccttaagtctttggctgaggaaggaactggaggaatgagggttcaaaaggaaatttgagtttatctctgccttcatagtagttggtcttaattacattttgaatgtctttggggaacaggtaaggtaataagggggattttactaggtgggcaccaccctcaggaagggcttaatcccattttgagtactcttcttgggctccctcctggccaagcccttttaccctccctaatttgattatttccttgcacttccccgtacactctggccccttcctctctaaacctttgtcataaggataagtatgcagcttgccagtgttcagtggatccaacactggagttgggcctgttagtagaaacaggctttattaacttttgccaggctctagaatggaggtagtttcatatcagacttgtagtgggcttgattcagaaagaagggtggctgagtagatggaagagcatagtatggcctttccctctgtgccagcttctccgtccctgctgcctcagtatacctgccagcctttttgcaccgaaggtcatttgtctgtgatgcccttggaatgggagcagaattcaccttgatattttttctcccccagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacaggtactggcaagggaaagtggggaatgggactgagggatgttcttggaattctgtggaacacaaccaaggaggccaatgtttctactccttgacctagcatttcactgaagacaaatgttgtaagagaggagaaaagcccaccatgagtcagagtgactttaggagatgcctctagcagacatcccataagagacaggacatgtgtgtgtcagtggactgaggctaagactcagaagagggccaggtgacaggggccaagtaaagggcaagggttgtttatttggtttacgtaatttctcaaataactaacttctgttggtttatttattaatttttaagatttctatcttcttttccctggagagttaagaatttttttttaagacctgtcagcaggaaaagacctttaatagctatttttttaaactctttaacacaagactggaagagcagagggagaaggtgagggaaatattaacagagggtgtgtgaagggcatacttctctaagggagatagtagtgacgctggctccactggccactcctacccccagtgagaagggcactgcattaaatgataagtgggttagtttttttaagcttatcaacatgtttattttttatactccacttgggtttcctttgtcaactttattactgtttttgttttgtttttttgcataagctcctctatctttgagaatttctcagctcttcctcttggttctagtccctctcccattccctaagggataggttggccgtctattagaagtgactgccagataaaagaaatggtaataatggctgttatgtctgtggggagttatctttgcactcccacgcacccctccgtgggcatgtgttcccataggactgttccgtgggtcataaggaaagagacacttgcatgcgttcaaattctttcccccttgttcagtagcctcttctttaagaagccagagtaagtatactatgagcttgcttgctggactgaggaggcaggtaattaagttagggcaatagataagaatacatgttttgagaactttgaaaaatttgaagaggtctataattactgcattcactgtactcactttattttgaaacagagtctcgctctgtcacccaggctcgagtgtagtgttgtgatctcggctcactgcaacctccacctcccaagttcaagagattctcccacctcagcctcccgagtagctgggattacaggcatgtgccaccacacctggctaatttttgtatttttagtagagatgaggtttcaccatgttggccagggtggtcttgaactcctggcctgttgatccgcctgtcttgggctcccgaagtgctgggactacaggtgtgagacaccgcacctggcctatttttaattttaatttttatagatttacaggggtacaatgcagttttgttatatggatatactgcgtggtggtgacgtctgtgctttagtgtaaccatcacctgagcagtgaacattgtacttattaggtaatttctcatccctcatccccatcccactttctcacctttccgagtccccagtgtctattatttcactctgtaggtccatatgtacacatttggttcccacttataagtgagaacatgtagtatttaatcttccatttctgagtatctactttttttgctcactttttactctctggcagtatggcttgtattatcttgaaatttctttaaaaagcccttccttctttgtgtgttcatgctgaacatgctgaacgcaccccatatctctaatcttgggttgtatttgtataattattagtaatgcctggctctctcaccagacttaaactttctgaaagcagagataataatgagtcttttacttaattacaacctaacattttgagcagagcgagtaactcacagtaggtgcttaatggatatgtgttgcatgaaaatataatcccattcatttctctttctgttttgtatacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggtgagaaggggaatttggctggaagcttgaagagggaggggtttagcaaaatgggaaggggaaggagtaggaaataacaggcctcattggactgagaggatctgatttcagggaagggtgaattaaactgacttattgaaatacaaactggtgagatttggtgtagcatcaaatctccctacgaagcaccaaggggttaacagctgcagtgctaatgaatgatctatccatgatttgatgactgttttttgagacggaatgtcgctgtgttgcccaggctggagtgcagtggcatgatctcggctcactgcaacctccgcctcccgggttcaagcaattctcatgcctcagccttccgagtagctgggattacagacgtgtgccaccacgcccggttaatttttgtatttttagtagagacaaggtttcaccatgttggccaggctggtccttgaactcgcgacctcaggtaatccgcccatcttggcctcctaaagtgctggcattacaggcgcgacgcactgtgcctggccaatgtgatgactgtttctaagaattctaaaaaattcactatagccaccttctgtacctctagctggaagatggaactctatcattaggattgagttcaaaattgccacaaatatagaaatgaaggattgtattggtaattttaagaaatgtgtatttattttaggcaatacagaagataatttagctgcttctttggatttgttttaggtggggccttgctctgttgccaaggttggagtgcagtggcaccatctctagctcactacagttctgactgcctgggctcaaacaatcctcccacctcagcctcctgagtaacggggaccacaggcgtacactaccacacctggctaattttatttattttttgagccgaggtctctttatgttgcccaggctggtctcaaactcccgggctcaagacatcctcctgccttggcctcccaatgtactgggattacaggtgtgaaccactgcacccggccatctttggatgttttttgagatttttaattcttgttgaaagcgaggctaaagggcaaggaaaagagttatttgaggatcctgacagttggtttccatctttctcactatcaggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatttttttgtgtaacttggtatggggctggggcacagaccaagattgacatgaaaggatgtgagatcgcatgtcttgtgtgactatctgcttctcagacaagcagttaggaactgagatgagatagtatgtgagggcagcaaaggatgaagaagggcaaaatgatgaaaggtgaggtggaaagaggttatgagatggtaaagaaaagttaacttctggcacttgattgccacttctgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctctagtaatgacaacattttagttgttagtggtataatacggaagagatattttgcacaggctgctttggagaactttcaaattatcctttgtttggtaactgacctacttaactgcccaatacaaagaaaaagca

SEQ ID NO: 1913 - DNA, 303039 bp, Homo sapiens
gggagattcgggaccatggcacctgtgcacggcgacgactgtgagataggggcgagtggtgagggacaattccgcgcgcggggctccgggttgggacagtggcatgattgccggtggtgggggttctgagggaggcgcacacccgggtttgtttgggcgcagaccttggtcgtccccggcgggggcccttctggcgtcggaccgggcttcctttaggcgcggtttgctcttggaggaccagagcctggagggatttttgtttgggaggctgtctcacctctgccactgagagtctccacagtcgattgcgtttctatttcttttggtgagttgcacccacgtgctgggtataactttattgagactggccccgtggggccgaaagtatttcactgcgatctccctaagtatccacttgaaggcttgaacagaacagatctgtgtccctttttgtaggaacttccaggaaaattttatacattgtaactaagcaggaaagaaagctctaagtgctgtcatcggggaataacgcgttttgtatttttaggtaatgggtttctactttatgcattaacaatttttctttcagattctttggaaagttcttcaagtgctgcgtagaaatcctgttcacaatctagtcattcctggtgaagtttcaaaaaaatggcatcaatttagggcatttcggatcccctgtatatcactccgtttgtcaggggtgtcttttatttccaaaaatagaatacaaaaatgcaaatagatttgtctgattttttaagtgttcaactaaagcgtgacttcagttaacttctaacttaaaatcagatgcttcactttgttagctcaagcgtcacctctcctgtcattcagatacatcaccattaatgagaactcgcttcctaatcagcttcctttgcattcacctagttgtgagtcacagatttcaatttgttctagccgttcgttttttaagactattttggagagtcgacctgcctggattacagataggatgttgggtgtaagtatgtgaacgaacagtctttgcaggcctctatcagtgatttgccactaagccctttcttcatcctaaaaactacgtcatctatgaacatcaggaaatcactttggaggatactgtgcaatcttgagactcctcttaggtcatggtgttcattaagtagttgctggggacttgtgactggaatttttcctttagagcagactgaaggattgttacctgaaagactgctgtaagctagtgtctgtctgcttttggggaggatagagatactccagatggtaattttgaaacaaatatttaaacctttgtagctggatttttttcatgcttattctttttttgctaagttacctacgtgaagcattggagacatactccaaaaaacaaaatgtaggcttttttttttcttcagtattagcaggcagggcaccttgataatggcagtgaaaagttgaaaggtctgtaactagctgttactatatatgaaaaaagatcagggaatttttatttatttatttatttttgagacaaagcttccctcttgttgcccagactggagtgcagtgacgtgatctcagctggctgcaacctctgcctcctgggttcaagcagttctgcctcagcctcccgagttgctgggattacaggtgcccaccaccacaccggctaattttttgtattttcagtagagacagggtttcaccatgttggccaggctggtcttgaactcctgatgtcaggtgatccacctgtctcttcctcccaaagtgatgagattacaggcatgagccactgcgcccggccagggaaagtttaatgatcaaaaaagcaggtacagtggttcattcattggttcattcagcaaatatttattatatacctactaggtataagccttctgccaggctctggcattatgatggtgggtaggctggacatggtttgtcttcatgaagtacagatggtaaacatctaatcatatgcagaaaacggctttgctttgtttttgccttctaaagctagaccttggtactcttaggtatggtgtgtgtggggtatgtggatgtgtgtttgacttcacacgcggaagcgttacatgagccgctcctatattgctaagtgcaaagtaagataggcatcttcatgtaatccttaacagattttgaagcagacatgattatccccatttcacagatgtggaccctgaggctctgcatcagtcagagcccctatctgtaagctgcaggaaccaactctaccagattggttagaatttgttagaagaatattgtgttcacagaaactccaggaggactagtaagccagtctgggagctgtttagccaggaacagtgagtgaaattgtgccacaaaaatgggccagtgaggaggtcattgccaaccacgagcaagtacttgatgctatagctcataccttaggacattgctgacattgttgccggttttgtaatccttctgcagctgttgctacttgtagaatcttttaaaacccatgcccccttccttgtgacactagcttctgatttaatgtctgagcaggtgttcctaatcggtagcgcctattttatatgcccatgctctaggctgcaagggtgtctgggaaagagcatcaaccttttcagcttctgtaatggggcataggctctgcgtctcatcaagacttataagggatgggggccggatttcacaaacagtttcagatgctaggctgctttaaataacaagacacctgtctgctgcttaactggttaaccggtgttctcatgtcacccagtaaatggcagagctggaatgtgctgcttctccctaacctggttctcctactcactctacactcccttgtcgaatttaccttgcacactgagttctctcagtttctgaatacactatgcattttcatccctttgtaatttggctcatgcctcttcttttgcttgtgccactttttactttgttctctgtgaaatttgactcctttttctaggcctgtattggaaacctctcctgtgaagccttccttgattttccaggcaaaattaacagctctctcctctgtacatttcctcagtactgagttcttaccttttctatggcaccatgtttatattgtgatggtaatttcaggtactttgctttacttgactgggggcctcttttggacaggcagctctgtcttatttgtgattgtaccctaaaccctgtgtagtggaacattgttgcctgtgtagtgggacgttgcctgtgtagtggaacattgttgcctgtgtagtggaacattgttgcctatggagtaagtgcatttgaagacctacagatgtcaggcatcaagggagtcttgaggggaatcgcttttcactttcaggggtcatgttcagtaatcttcaaagccttttcatgtaggcctgttcacgatttttgaaatcatttgagtgacatccaagtttttgtggctgtcatcattaagtacctttattccttaatttttacttaatgtctttctgaaaatggatttaaaagtcaaatgtgaaagtcaaacaatagagtgtgatattataaagagagattccatttctagaaagctagaaaaaaataagatctctaattatgccttacctttaggctatagtttccagcagtttattgccagcatttggtacatgttctttaaattgtatcttctatttcagtcaaacacttagtcaagcagcttaatgttgttatgaacattctagtggggttggagttttaggctgcctcttatccatacttcttttctttgcctgctcctttttataaattaattagcaccaaacacagtaaaatactagatttcacagacatagatggcaatcatgctgagcctaaactcgtagttgacaggcagcactgttatgcttgacttagtttttcatcagtgggtatgtgaaagtctttaattctgtggatgaatttttttttttttttttgagatagagtctcgctctgtcacccaggctggagtgcagtggtgcaatctcggctcactgcaacctccatctcctgggtttaagggattctcctgcctcagcctcctaagcagttgggattacaggtgcctgccatcacacccagctaatttttgtatttttagtagagttggggtttcaccatgttggtcaggctggtctcaaactcctgacctcaggtgatccacccacctcagcctcccaaagtgctgggattacaggcgtgagccactgcatccgcttgaatttttttcagtgtgtgtgtggaacggtcagtttatgatgatcggagcatgaataattcaaaagttgaatgaataaacgctgaagtcctctgatatttcagtaatttttgacaaaccatttaagtccctgtagttgttttagtaatgtcctgtgtcataaccaactgaggccttgaaataagtgatataccaataatcccctcagagccatctttgttaaatttctccagccctcaatctgttccttctttgaatttccgggtgctttggctgaatctcttttaaggcatttattatctctaaatattgtttagagccagttgctacttgtctcccatgttagatagtaagttctgtgagtacagagaccatgtcttttttatctttttttgttgttgttgttttttgtttttgttttttgttttttgagatggagtttctctctttttgcccaggctggagtgcaatggtgcgatctcagctcgctgcagcctccgcctcccgggttcaagtgtttctcctgcctcagcctcccaagtagctggggttacaggcatgcaccatcatgcctggctaattttgtatttttagtagagatggggtttcaccatgttggccaggctggtctcgaactcctgacctcgggtgatctgcctgcctcagcctcccaaagtgctgggattacaggtgtgagccaccacgcccagcctgtctttgtgtctcatagtgcctagtactttgcaaagagtagatgctccttgaagccttttagatattgattgacagattgcaaaatgaatagtgcttttataacccactggattacttctggctggtcatttctaatggaaaggtgataaattagctaacagctgatctcccttgtttagtgtctccgcaggatatcagttgaattgggaattttcctctttttagagaaaaaaataacagtgactttaattgttttaacaggatcttggaggaactttctggcgagtcatgtatatttggatatgtatgtttggccatgagctttgtgaattatttacattataaacattatctacttgtatattactaaaattgtatgttattgttggctagaaacttttcctttgtgtttgagggaagatggctgacaattttgtaacatctgttgtaaattttttttcttttttcagctctgtcagattcagggagttttgtatcttctcgagcccggcgagaaaaaaaatcaaagaaggggcgccaagaagccctagaaagactgaaaaaggctaaagctggtgagaagtataaatatgaagtaagtaaccatttttcttctttattcttcctgtgcatcatctaattcatagcctgcaggtagtcttatgtcacctttgccccagattagaaatactcatatattttaaactttttgtaatgggaatttattagtattggacaagcatgggtatgaggtagatttacagatcatggagaatgttcgacccttaaagttcctataaggtattttaaagatgattttaaaattccaaaatgaaagtacatagtcatatctatatttttccttattgagcatgctgtatctatggtaagtcccatgggtttgttggggtcatttagagatgcttttacttactcttaaggtattgagcagtctaagtgctacttcttggagagaactgttcttcctaatctcatttgcaagggtagtggcagtggagacttggaccttaacttctgccgtgttctgcttgtaagattgaatgtgatgctcttttggttttcctctacccactgtttatggcctgcaggtcaaaaacagagtggccaccatctgcataaatattgtctagcatcaccttcagggcttcctgagtatcttaattgccttatggccagaaagtgattaaccaatactagaaaataacaaccataactgatagactttttgaactaacatattattctaagtgtgtttaccaatgtgtttattcatttaatcttttcaataaccaaatgaaattagatactatgattaataacattttgcaggtgagatatccgaggcacagaaagtttagtgaggttacaatggcagattcttttttgaacccagacagtctggcttcagaatatttctgtttaaccagttaaccaaataaaagaatatttgccatttgtcaccatttgttcaagttaagtgaggcaaccagatcataaaaggttgctaaaaggatttcagtaaaacaggaataaagcattttttttgtttttgagatggagtctctctctgttgcccaggccggagtgcaatggcacgatcttggttcactgcagcttccacctcccaggttcaagcgattctcctgcttcagcttcccgagtagctgggattacaggcgcccaccaccacgcctggctaatttttgtatttttagtagagacgggctttcaccatgttggtcaggctggtcttgaactcttgacttcaaatggtccacccgcctcggcctcccaaagtgctgggattacaggcgtgaaccaccacactgagcccaggactaaaacatttttaatgtaggtacttgtataaaggagttccatggggcatttcagatgttggcacaatgtggctgatttccctttaacactgtgatgttaattgtatggctctaagagttcatgctgagcagtagtaatgttgtttttaaagattgagtcgaaatgactttttactcaaaatgatttttaaaaatagttttctggtatctccttgataatatagtgaatcacttaagtaagagacaaagtctgtcttcaaccaacaaaaataataacgccagttcccctcccacccccaaaaaagaaagttggtcagtatagtaatattaattggactattttgcatctcttttgttaaaagcttaatttggtaaggcaggttgtttctgttactagatggttaaagaccaaatcagtatttgccagtgattcctgtagagtaggctaaaaaggaggtgaaaactcaaatcccgtaattattataagccttataggtgtggcagaaatccagtcagctctggccactggattccaaaagctctgtccaagttttttcctagggtattaactcttcagatggagttgtttctcccgtactccatttgagaaaggtagaactcttttttttttttttttttgaggtggagttttgctcttgttgctcaggctggagtgcgatggcatgatcttggctcactgcaacctcagcttcccaggttcaagcgattgtcctgcttcagcctcccaagtagctgggattacaggtgtctgccaccacgcctggctaatttttataattttagtagagacggggtttcaccatgtcggtcaggctggcctggaactcctgacttcaggtgatccacctgccttggcctcccaaagtgctgggattacaggcgtgagccaccacacccggctgaggtagaactcttgagagaatgggagaattttttttttttttaatctcgctctctctcccaggctggagtgcagtggtgtgttcttggctcactgcaacctccacctcccaggttcaagcgattctcctgcttcagcctcctgagtagctgggattacaggcgccccccaccatgcccagctaatttttgtatttttagtagagatggggtttcaccacgttggccaggctggtcttgaactcctcacctcaagtaatctgctcaccttggcctcccaaagtgctgggattacaggcgtgagccactgcacctggccgagaatcaggtactttttttttttttgagatggagactcggtctcttacccaggctggagtgcagtgcatgatctcggctcactgcatcactgcaacctccacctcccgggttcaagtgattctcctgcctcagcctcctgagtagctgggactgcaggcatatgccaccacgcctggctaatttttgtatttttagtagagatggggtttcactatgttggccaggctggcctcaaactcctgacctcaggtgatccacccacctgggcctcccaaagtgctgggattacaggcgtgagccactgtgcccagcatttgttaatttttaataagtatctatgagattttgcaaaccagcccaccagagtctcatctggaaagtcactggcctttccccatgggcagctgcagcagtggtgtgtatctttcatttgttgctttagctgtgcagaggttgtctgctttactcataccagtagctcatagtgttctgaccctcttgcagtcaggcagccaatatgattggaggacctgccactctctggacttgcctttcaaatagctcagcgtttaagtccttgtgtggtttcaagacctgaggatggtggagtttcagtggtaatacaaacagggtcactcaaaaactatttctggtttgcctgtagaatatgcaatatgtttgttttgctaatttttggaaggggatggatgagggagattttccttctgaattgtatttggttgattgaacaggcatgaaaattatcgtctatttgcagagcgtacatcagctagtggagagggaagtggcatgccttacaggtttgctaagtgtaggagaaaccagtctagaaattacaagtgaataattccccaaagcagctaatgaagaattggctataattcagtttgttttttatgaaatagatgagtaattgatggtatgacaagtgtattatgctaatggaatcatttaatatcttatgttaacacccacctaaaaggaatactaagttaattgatgtctatttaaggaaaaccctgtagtggtgttgaatgtcagaactcatgatttggttgcagctactccttcagtctgccattccagtttcaatttgacaattttttcatcagaattatttaacactttgactcctctatttgaagcttttttcctgaaacttgtataatggtaggtcgaggacttcacaggtgtttatgaagaagttgatgaagaacagtattcgaagctggttcaggcacgccaggatgatgactggattgtggatgatggtaggtggggcggaggtgggggcggggatgttgcttcctaggcactgtgttagttgcttcttgtagattctcactcatgtggtggagttgctgctttgcctgggcaaatgtaaggcactgttaggatcttacctttggtttggattttcctttaattatttgaggatgaggaagcagaatagcaggacatttatttggggatattttggagaatctaggcacatacctcaggatgtagtataaatcctccaggtaatggctgtgtaagaattgggaggagccccttgtctgtggggccaatgcacagcgcttggaattaaggaatgcaggttcgggatccatcattcctactttccaattctatgaccttggacaagtcacttaatctctctgcgccttagagtcttcatctgtaatatggggatgagaaaactaccttctcccagagttgtgaggtgtatatgaggttctaggtatgaaaattaacttggtcagtagaaagcaccatacaaaggctggtcctaatgtcctgtgccccttctgaaagctcattggttctcacttgtagggtctgacttcatggccatgtgaatgctgaccacagggagcatgtagattgtgcctgtgactatttatgtttctacttgtgtagttggattcagctatattgccagttttcccttgtagactgggatatctctctgggcttgtggtaatcttgattcttttactttttattcttctggtagagtaaaactgctataaagcatcctattgtggcagactttgatcctttgggccaaatcgtttcctgaggtcacctgactaggtataatatatatcatttggttttgactccacacctgctgtgtggatgctgtgcattgtctgacacctgtgtgaacagaattctgctgcacttaaaaatagcacaggccaggaaaacatctgagcaggtataaaaggtttttttggtcatggctaaaatattattggccacttttagaaatttgatcccagtattaaattttgtccctgcagatggtattggctatgtggaagatggccgagagatttttgatgatgaccttgaagatgatgcccttgatgctgatgagaaaggtacctaccttttgttttccagggtgttgttttgagatttaaagaattctctaaaattagagatgacttgatactctgatagtttacctttgagagaaggacctaactaccattgtttttagatacggaatatgttctaagatgaagagaagtatggttttgtggaaaattaaacataaaaagcagaaacaacatcaggaaatgaagtttcatgtctctgttattcaagtagtgtggtctttacttattttgaagttttcaatcccgtggtcatttaaaacttgctgattttgagggctgcaacagtaattgatcttttttaattcctactgaagttatatacttagaattttagctctttgctaattgtatagcacaataacaaggtttagaactagagtaatcagcttgctttgtctaattgaaatttaaaataatatggtgaatgtgtcagattgtcttagctgtacaatcattggcaatttttttttgagtaaacaatcctgatttagttcctgtaaaatgggaatggaaaattctcttcagtatttttttttgtttagtttgttaattagttttctactactgagtggtagattggggtcagcaaactatggccctctcacaaccagtttttgacaaaaagttttattgagatacagttcacataccatacaattcacatatttaaagtatacaattcagtggcttttaatatagtcacagagttgtgcagccatcaccacaatcaattttagaacatttttgttaccccaaatggaaatcttgcctgtttttgtgtggctctcgagctaagaatagtttttatgtttttaagcggtattttaaaaataaaaaatgcaaagaatatgtaacaaaagaatatgtgaccaaaagcctaacatctgtgctgtcttgccctttactgtctggatcctcatttgcagaataatattttgcaccattagttttctctctccttccaaccacatacacagagactttttgctcagtgaacttttagaacttcagcagtgacctcctaagaataaggatacctgactacttaaccacaataacattatcatgatattatctaatatattgtctgtattaaaagtttcccaattagcccaatagtatcttttaaagctattttaaatgcagactccatttttgttttcatgtctctttagtcttttttagtgtagaacagcaacacctccccccctcccctgcccctggcctctttttgtctttcatgacattgatttttaaagggaccaggctgtttgttttgttgaatgtcccacaatctgagttttgcccaactactttgttgtgcttagatttgggttaaatattttggcaacaataaataaatagttataaataaatgctttgtcaagacctacaatataaagtctgtccttcccatatcaggggcatatgacgtcacttgtaccattattgttgatactaagtttgatcttttggttaagatgatatttgtcagatttcttccttgtaaagctactttcctcccttttgtaattaatgcaaaatagggggtgataatttgagaccatgtgtatatcccatttccccatgaattgttacccagtgcttttagcatctattgttgatcctttctcttcttttaaaaattaatgcttcagactcatgtatttctaaaagatttactgttctaattcagtagccattattatcatttttcctttttatgttcaaattatctcagatttggctggtgagagcccctttaagccacctcctatgttcttttgacatggctccatcagtctttgaggatttccttgctttctgggccaagaggataagatgttccaggtttagcttgcattcttcctgccctggacctggaaccaaccatttctcccaagaatcctggttccttttagtggggaatggtatccagatatgggagatggatgtactcattgctattggggtgtaacggcttctaggccctttcagtgaacagaacaaggaaattatatatgtcatgagttcatacagatatatttgattggttgaaatccaacatcactgggttctttatcttcccaattctatatttgtatctgccttcaccctcaatgaaaacccttgtcttctaaaatacacacaaaataatgtcagaatcactaaatcaatatctgtactaacaacctttctaagtaaaatttatgatttctctacagttttatttgttcttgttatatatcctaagggtctatagtcagagtattgtgttcagaagctatataaagtaattttttgtgtgttttgtattgatttactatgtaggttcattttttgtttgtattcaaatttcagttttaaaaccttttaattttacttctgaatattgtaaaacatatgatttaaaaatgaaaatcagtaacttttttattagtttctggtttattacaaaaaaataagcatatgtatttttttctgtgtgatgttatttatttattcattgatttattagttaaattagaatatgtgaaccatcttcctggttctgccaacctgtataatgtggaaattttctacactggtaccatttggtagcaatgtggccaattgtgtatttctagtttgtgtgagtccatgaagaagagaatgagctcatgtgccactttcatctccctgaactgaggaggcctatgttagagttacggttctattgttaattggcggtgtcatcttgaactaatcccattacctatctggacttgagtttttgtcagctgtaaattaggaagttggaatggacagtgagcttctcaaagaaaggactcatgtcctggtaatctcagtgctaatcacagtagtggactcaaagtaaatatgtagttttgttgaataaaggagccatctctgtgtttccatagtcatcatattatctcttccgagtaataagttactgaagagaatgatttgatctggaagagagctagtcttagaaatttttatttcgtgctttgccaccaccattcacccacaagtccccactgttttagtgtccattactaggagcccagtaaggtcacaagatcctaggaaggaaaatggacttctgcaatgtactttaaaggcttataagaaattactaagttttgcttagaagtaaaaagtcaactatggtgtggctctaattcctgggatgttgttttcaaacagagaaaaatggccgggtgcggtggctcacgcctgtaatcccagcactttgggaggccgaggtgggcagatcacctgaagccaggagttcaagaccagcctggccaatatggtgaaaccccatctctactaaaaatagaaaaattagtcgggcgtggtggtgggcatctgtaaacccagctacttgggaggctgagaatctcttgatctcttaaacccgggaggcagaggttgcagtgagccaagatcgtgccactgcactccagcctgggtgacaggaataaacaaaacaaaaccatagagaaaaatatcaaccaagtcccagtgaagaaaaattagcaggaaaatgcaataaaacaaaacagaaacactaaactgtggaagaattccacctcaaatatttacttgtattcaaatttttatccttctgtctaaatcctgccaacctacagtggtgagattaaagccctctcatgaagccttccttgctattcaaacctctgttgacctcctctgttcatacactatcaagacctgaattttatatactaaacattttgactattaattacattctgttttcagagtgctccagatgatacagatctcctgtctcacatttttcacaaatgtcctacaatccttttcacaatcttaggctcatgaaaatactttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtcttctactttctacacagacacggcaaccatccgatttctcaatcttttccccacctttcccgcctttctattccacaaagctgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccagacggggcggctggccgggcggggggctgacacccccacctccctcccggacggggcggctggccgggcagaggggctcctcacttcccagtaggggcggccgggcagaggcgcccctcacctcccggacggggcggctggccgggcaggggggctgacccccccacctccctcccggacagggcggctggccgggcggggggctgacccccccacctccctcccggacggcacggctggccaggcggggggctgacccccccacctccctcccggatggggcggctggctgggcggggggctgacccccccacctccctcccggacagcacggctggccaggcggggggctgacccccccacctccctcccggacggcacggctggccaggcggggggctgacccccccacctccctcccggatggggcggctggcctggcgggggctgaccccccccacctccctcccggacggggtggctgccgggcggagacgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagatgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgtggggcccgtccgctcctccagccgctgcctcccgggcggcgctcgccggcgcctttttttttttttttactgtggtaaaatatgtataacataaaatttaccacgagtgacatttagtatattcacaatgtttgcaaccatcaccatcatcttgttccagaacattttcatcatccaaaatggaagccctgtacccattagcagtcactccccaatctctcttcccccagagcctgacaaccatcagtcagctttctatctttatggatttgtgtattctggacattttacatttcatataaatgaatcatgcagtattttatcttttgtgtttggctttgacttagcagaagattttcaagtatcatgttttcaagtagcatgtatcagtacttcattcctttttactgctgaataatattctgtgtggatgtactacgttttgtttattcattagttgatggacatttggattgtttctaccttttggctattgtatgtagtgctactatgaacatttgtgtacaagtttttgtttgaatgcctgctttcaattttttagggtactaacctaggagtgaaattgtgtatatgttgtggttttttttttttttttttttgagacagagtctcgctctgtcacccaggctggagtacagtggtgccatcttggctcactgcaacctctccctcccgggttcaagtgattctcctgcctcagcctcccaagtagctgggattacaggcacgcgccaccatacccggctaatttttgtattttagtagagaccgggtttcaccatgttggtcaggctggtttcgaactcctgacctcgtgatctgcccaccttggtctcccaaagtgctgggattacaggtgtgagccaccgcgctggcatgtatatgtatttttatttccttttctttcttttttctgagacagattcttgctctgtcgtccaggatggagtgcagtggtgcgatttgggctcactgcaacctccgcctcctgggctcaagctatcctcccacctcagtgtcccgagtagccaggactacaggcacatcctgccacgctcggctaattttttgtgtttttagtagagacagagtttcgccatgttgcccaggctggtctcaaactcctgggctcaagcagtccgcccgttttgccctgggaaagtgttgggattacaggcatgagccacggtgcccggccccttttctttcttaaacaaaagataatgttatagaggttttgtactttgcttttttcttgtagcaagatgttttgaaaattaccccatattagaacatagagagcttgtttttaattatttatttctatgtagctgcatagtattccatgatagggattgcacaatgtttattcaaatggtttccttggaaggacatttagattattttgagtaatttgctattataatgccacatccaataactctgtgcatatggcgttttcctcagagaaaattcccagaagtgggattgctggctcaaagagtagctacgcataaatttttttttttttgagatggagttttgctcgttgcctaagctggagtacaatggcgcgatctcggctcattgcaacctctgcctcctgagttcaagtgattcttccgcctcagcctcctgagtagctgggattacaggtgcctgccaccacacccagctaatttttgtatttttagtagagacggggtttcaccatgttggccaggctggtctcgagctcctgtcctgagatgatccacccgccttggcctcccaaagtgctgggattacaggcgtgagccaccacgcccagcccactacacataaaattttattagctattgcctattctttataggagctgtcccattttacactctcatgaacaatgtatgaatgtctgtttctctacagccttactaacagtgttttcaagcttttgaatttttgccactctgatatgtgagaagtggcatttcagtgtggttttcatttgcatttttttttgtttgtttgtttttgagactgagtctcactttgtcacccaggcaggagtgcagtggtgcggtctcaggtcattgcaacttccgcctcctggtttcaagcgattctcctgcctcagcctcccaagtagctgggactacaggtgtgtgccaccatgcccggctaattattgtatttttagtagagatggggtttcactatgttggccaggctggtctcgaactcctgacctcgtattccgcccgcctcgtggcctcccaaagtgttgggattacagatgtgagccaccatgcccagcctcatatgcatttcttttacatatgaaattgatcatcttttcataaaacgtaactatttatatatgtttgtgtttactgcctgctttccttttgggctttttatcttttaagtttttaaaagttctttgtcagggaaattggtcctttatctgtgatacatattgcacaaattttttcttcatttttcttttaacttggttttcttttttcttggtttttctttttacaccaattctggtgtaattgaatttatcattttttttcttgcaagtggattctgagtcatagaaagattttcactggacccaaattgcaaaggaattgctttttaaaaggtttttgtaaagtttcatttttaaaaattttgatttgtgatccatttggtgtttatactggtttacttctttacaaatggctagccaacactacttaataaagtccatcttttccttagtgatatgggatgccaccttcattatatattaaatttccataagtaattgggtcttattctggactttatgttctgtttcatttggtctatttgtatgccactaccacattcttattttttttatttttttattttgagacagagtcttgctctgttgcccaggctggagcgctggagtgcaatggcatgatctcggctcactgcaacctctgcctcctgggttcaagcgattctcctgccccagcctcccgagtagctgggattacaggcatgcaccaccatgcctggctaatttttgtatttttagtagagacagggtttcagcatgttggtcaggctggtctcgaactcctgacctcgtgatctgcctgcctcggcctcccaaagtgctgggattacaggcgtgagccaccgcgcctggcctaccacattctttcaattattcattgttggcttttttttgagatcaggactattctgggatgaatcagaaagcgagagtaaaattgacggtattagaaaagtttgtaggtgatttacacatagccgtaagagaaaacatatggcaaaagttttgtttgttttttttctttttcaagacagagtcttgctctgttgccaggctggagtgcagtggcgcgatcccagctcactgcaatctcgcctccggggttcaagcgatttccctgcctcagcctctcgagtagctgggattacaggcatgtggcaaccacgcctggctaattttttgtattttagtagagatggggtttcaccatgttggccaggatggtatcgatttcctgatctcgtgatccgcccgcctcggtcttttaaagtgttgggattacaggcgtgagccaccgcacccggccagcaaaagttgttctttaatgagcagatgtctctgtgctgtttagtgttgatatgacatactgtgtatctggttgctgtttctcataaaatggaaattaggatgccaccatatcataattggtaatcccatttcttcacagttaaattttcctatcagattcagtatacagctaaagagatgatctcatgaaggctactaggctaatttcttggttcaagattagctttatctttttatttctgtggggaaaacaaacccaaattctcacttttttaaaaagctttttattcacattaacaatagcagttaagcagtcacacttatgctgatatttaactggtatttcattagtttctataaaaacatttggcccatgttttcttgaattaaactcatttaaaatattttttcctacataccttgtatagaatctcatagttttgttttgttttgttttttgagatggagtcttgctctgtcgcccaggctggagtgcagtggcgtgatcttggctcactgcaagctccaccttctgggttcacaccattctcctgcctcagcctctggagtagctgggactgcaggcgcccaccaccatgcccggctaattttttgtattttagtagggacagggtttcactgtgttagccaggatggtctcgatctcctgatctcgtgatcctcccgccttggcctcccaaagtgctgggaatacaggcatgatgtatttttaattcttaacatttttcttcccaatagagatcaagtgactaggcttttagttttccattttgatttttgctgatgcatgtttctaaataattcatattccaataggaaaagatggtaaagcacgcaataaagacaagaggaatgtaaagaagctcgcagtgacaaaaccgaacaacattaagtcaatgttcattgcttgtgctggaaagaaaactgcagatgtgagtttcatggtttccttattttttgtattttcctttgtgaggtgaatttaatatttgattatacagataacaggtgctctgtatatatttgagtaacatttttccaatttcactcactaagttggatgtagatttctaagtgaattaaggcacctcagtggttggaacttgcgaaatggaaaagagaattgaacagaaaagctgaattgagagtgtgtttaattttagtgagtagcaggaagatcatggattaagggcgaaagtagaggatgggagctatagatgtaggaatgctatatacacaggtggttgttaaaatctgtgaatgtagatgagcactcagagagtgaggaatgaagaggcaaggactaactggctaggtccttcctttcatatacatgtgtgtagttttggtgagacattttaagtgcaaggctttctcatgttacctttctttatcatttccagaaagctgtagacttgtccaaggatggtctgctaggtgacattctacaggatcttaacactgaggtaaatgaatctccaggagttgtaaaatatgcagaggacatagactgaagaaacactctagtaattatacaaaacagactattgccagaattttttctttttttttgaaacagtagcttgcactgttgcccaggctggtgtgcagtggtgcgatcttggctcgttgcaacctctgattcccaggttcctcttccctgattcctgcctcagcctcccgagtagctaggattacaggcacctgccaccacgcccggctaatattttgtatttttactagagactaggtttcactatgttggccaggctggtctcgaactccttacctcgtgatccgcctgtcttggcctcccaaagtgctgggattacaggcgtgagccactgtgcccggcctgttgacagaattttttaaaatgtaagaacgccaacaaaaaaccccccaccaaaaaacaaagaaacccccttcagattggttttatcccaccattttaggtgagtatttccagctgttagagctgtgtgattatgtagatagggatgtgtgggtgtgtgtttgaagtagtaagaatatacccaggagtcagttctgtgagtgctcactgcttgtgttcagttgctgtggtgtatgttccctaaatagattgaagcctgtcaatctgcacaatcaggtataagagccttgtcttgaattctgagtgggaatgaaggaagagtgagtgaactatccctgatagaactcaaacaggattagctgcattgtgaatttgagatttggccatttcccataaagactacgctctcatttagaagtgtacttcttttaaagtgaccattgattaaaatgacttaacaacaacaccatgtagttttatcttgacaatttttaaatgtaatattctcaaagggtcagtgaaagtatgttaaattttaagaagaaaaaatttgggagggggtagatttaatatctattttagttttcttgtgatttctatagtattgttgctatagtaaccacagtacatgacatcgatgggaggggggagggggaaagggaaagaaaagaaagctttgcttattgggcttcaatgagtgaagaagtatactttttctgtctgtggtaaaccaagcatggcagtgaatatgtcttacctttccttttagacacctcaaataactccaccacctgtaatgatactgaagaagaaaagatccattggagcttcaccgaatcctttctctgtgcacaccgccacggtaaagtgtgtagagataccttcaatcttgatttatagtattgctttaaacttattttgttgcttttctgtatgagggaaatacctttacatttgtttttgatttttgttttaaattaggactcccattcaatttatagtttcatgtatttcaaaaatagcatgtgcctgcctttttcatagtaaatttgcagtaactagtgtgtgtttattataggtattacaactgtggtaaatgcaataattttcctcccagaagcaagtatttttttgtaaacctaggtaacagtaaaataattgaagctgttacattaataatacataaaatctttttataaaagggaactgtcattatctttggtcagggtaggacagttgcatatttttagtatgtaggtctaactgactaaatatttaaaaacgtttacaggcagttccttcaggaaaaattgcttcccctgtctccagaaaggagcctccattaactcctgttcctcttaaacgtgctgaatttgctggtaagtgtgatgtcaggcagaattgcaagagtgttgagtggtttctgtcaaaaatggaggccctatgatggaggaggtagaggagattttgaaggtgttgtgatggcaagtttaaatgtgaagatttgaattcataaaaatttcagtaaaagttaaaaacacccaatttggagattaaagagaaatgcaaacatagtatagaaaagggacaggctgctattttagtgttggataagcctttgtgcgcctttgtgtgcctttgtgtgcctttgtgtcatcgcaataacacatgacaagaatgtgtgatgatgcctacaggcgatgatgtacaggtcgagagtacagaagaagagcaggagtcaggggcaatggagtttgaagatggtgactttgatgagcccatggaagttgaagaggtggacctggagcctatggctgccaaggcttgggacaaagagagtgagccagcagaggaagtgaaacaagaggcggattctgggaaagggaccgtgtcctacttgtaagagcattttatgacttttctggcaaataggaccacaatttttctgttggattttgaaaggtttttgaaaatgtgatttctgcagaggaagttttctcccggatgtctcttgttgggacattgatcaagaaggtgatagcagtttctcagtgcaagaagttcaagtggattccagtcacctcccattggtaaaaggggcagatgaggaacaagtattccacttttattggttggatgcttatgaggatcagtacaaccaaccaggtaatcatatataaggtaactatatgcctttaactcagagtaggacttttcccttaaatattttattttttgtttctttttgtgtgttttgtctttttatttaatcagtttatttctgttttttttttctttatccttaaatacttgagtcactgtaattagctcaggtcaggccctgccctcacttaacatgtattgtaagagagcgacactcattcattgtaaagtgaatgcgccaccctgatggagaagagctatggtgcgaataatccttaaagatgcttattccaaaaatcagttacatatggttttggaatgtgtgtttgtagttcactattgatgtgtctgaagttacaggaatgcactttaatttaaagggaatcagtcattaatttgtctgtttcttcagcaaatttgaatgcctattgtgtgctaggcactgagatgggatgaataagctggacaaattcgtgcactataatggagcttatgttctaggagggtggcagtgggtgggggcacattagcagtaaatgagataaattgataaatgatgtaaagaaaattagttgggcgatggccaggggaggcctgtctgaggaaatgaccactgggctgagatttgaggtatttgcagagctggtgaaagggcatttcagcttaacgagccaagtactagcaaaggcctagagagaggaaggaggaggcctgtgtggttgtagcatagtaatcaagtgacaagattggtataaaatgaagctggagataaagacaaaggccagataatgtaggactttgaaagcctcgttaaggagtttgaatcttctaagagcaatggggtggcattggagggttttaagtacagggggtggtggtcacgtaattgggtttacattttaacaggaacagtggtttgtgtagagaataagcactgtggtgcatgtgtgcgtgtgcacacacacgtggagggatgggctggtgtagggtaatggggaagtgtggaagccctggagatcagtcaatccagggcagggctgctagttacttggaccctggtggctggagaggagagaagtaaaggcatttgacatgtcttttgacacaaacttgttaatggattggatgggggaggtgacagaaaggaggaatcaaggatgatttctaggtcatcttaatgagctaatactgtgaattcttgactcacaaaaagcccggaggctgttcggtattcttttgtgcctctttgagcccgtcttcattgtgggactgtgcattgcaagatctgtcagattaatgttaaatacagtatgcactcttaaacagagttgtctttatttagatcctttttggatctgtggtacatgcaaatagtgtatttttcaaagcggtttcctggaggctgtatctagtgaaaagagagggagtacctagatgtcagcaaagcaagcgtgtgagtaaattgaaggccacatttaccttaaagataaccaggcattgactttaattggaaaaatgttaatgatctctggcaggggtgggggcggtcagaagcattaatatgcttcagcttatcaaatatatataaactcttgagccacttgagtagcacactgccatgtgttagtttcttaggaaaagatataatcaattttagaaatgatatcttaatttactttagctaggacaaaatgatttgattataccccctcacctctttgactattttgttactctgctggaagtctggcaagtatgattacatgaggctaagcagatgatttcccatccattgctgaaacccagggctgccccattgtacaacctcagggaataccattttcacgtgactttcctggagcacagcagtgtgactggtgctccctggagctgggcagcacactggcctggctatcccagtattactccccgtactttgctgcatctgctcaatgctgcatttcattccctatcttggttaatggtcccatcaaaaccagaaacctgggagccatccttgattccctccttttcctcactttcctttccaagtctggttagttttctctgccgaaagtggacaacttaccttctctttttcctcatatctaccaccctgatcccttcttgcccactgaaacaattgcaccagcctcctaattgatctcttagctatcgtcttccacatcactgctagagggactgatcagaagggcaattctgaccatgtcagtcgtcattaaaaaaaaaaaatcctcagtggctactgcctacaacataaagtccaaactgcttagcaaggcttctgatgcctgctgtctatgaattttgttccctagaaataattctctgtatgtacttttctgctctttatacctgtgttcctttactccttgttttttgtctgattggaatgtgctcatctgactcattctttaaaattcagcccagatgttatctcctgggagtgtacctaaacctccagacgggtctaggagccctttctccttgtgactacatcatagcctttcccactgtagcgtttgtcctattattttgaaatgaactgagtctgtgtttttctttgccacaaagcctgtaagctcctggagggctgggatcttttatttccagcatccagcagcaatgccttgcacatagtacgtgtttaataaatagttgttgaaataaactgcacagtgactgacagtcctgtagatgcaggtgaaaaatttcagagactagtgttgcatttgctactattcctgagtttgcatcttaatgccttgtagctttgtggggtatgagaatgcgtaacacaaaagcaaatggttccccactcccccacaaccccacaaagtaaatacatccataaggcttcatattgccagcgtcagttgccaaggattagaaccttaagaagcaacaaccttctttctttcttatttgaaaatgagttggttatttctacatttcgtttactggctgatactcttagtaaacagagcattgttttgcagggtaaggatctagagctgcattgtccactgtggtagccaccagccacttgtagctctttacatttaaattaattaaaatgcaatacaaattaaaatttattttcttggtcactagccacatttcaggtgttcaatagcaactgtggctagtagctaccatattggatggctcagaaacaacaattccatcatcacagaaatttatttcaactagtgctggtctgtagtgacaagtgttggaagattgaagcattgaagcacagttatatttgcaaagcaaccagtttatgatatatgatggtgttgaattcctggtactgaccatagtcatggataggctttttcaaccaatattggaaaatattttgcaattgaaagagatactaatttgttattgatctgtcatccaaatgctaaggcagaatgaaatttctggtgctggagaaggcctcagagatcatctagtctagttatgcacttaagaaactgaggctctgaaagatataatagctctttagtggtagaagcttgggcttctcaccctcagtccactctgctgttctggttccgtggtacttctcaagttgtgttctctcctatggcacatcttctctgttattgatgccaacgggttaaataagatagcttaaaaaaactcctttaatctcagagtgttgaacactttcattgtgatagcaggtaatgatcactgagctttggtgaaatcaatgctgctaataaaaatgaagtactccaaaagaccctgttattgtttctcactttctaacagattctaagtaagtcagttgttgctgaatgctccataattatgaaaagaatcttactctttgcatatgggaagatatcctgtcttcattatgactttttcaaggttgaataatcctgactgcacctggtttcagctagtaactttggggggaatgtgatctttgtttaccatgatctttgttgtgtcaaatgaggcataaacagtgtcaaatgtgttgcatgaagtgtgatattagtttgacagtaaaatgagcttatttgaatctttgaatccaatattagggtctttatttttctttgcatagcattttgtttttccatctttaactgttgtgaggatgacttttaattttctgagttactgtgattttttttctttcttaatcttcccatagtccttccttccctctccctccccatccaccctccgttaccccctcaagctgaaagtctcacaactcttgtaagaattttaatcatctgcagaaatgaaaattcttagatcgtcttatttctaccaggatgtgtgaaaaaaggagtcactgatgagtagtctttcaaactggggtaattgaccttgtgaacagtagcctttgcatgtaccagaattttcttagtgtctcagataagtggctgtgttgagtggctttgttgattactgctgtctaattattcatggagcccaggattttgcacagtgaccatctcctgggttgactaacaaatgtttgcagtctgttcttcgtggccaattttcataaacaatgatttgatgtctaaaaaggtgtggttttactttatggtattcattacttaaattactgaaatagaatagaaaggaacattataaacacttacctagttagatgtcctaagtagctgtgaggtagaaaaggtgaaatagaagataatagtagtccctattgtgaggtatttattattatatggaataagaaataagaagtaaattatgttttttgtaaacacagttttacatatagaaaaacactgatgcactagttatcctgatacatgaatattggtttttataggtaaatacaagcgctaaaaaattagaattatattctcagatctgtaatctcacaagaggcttaattatgagatttgttggaaaatactttccttatgtttgtttctcttttttttttcttgagacagggttttgctgtgttgaccaggctggtctcaaactcctgagctcaagcgatctgcccacctcggccttccgaagtgctgggatcacaggcatgagccactgtgctcggcctgttttgtttctcttaatctgtataatcctggttgtggggaaagtgtttatgcaagttagagaatcattctgtcccctgtcctcccagtggtcatacactgtatcattgtgttagtgtagtatggcatcagtactgagtaaagaactggtcttggggagtgggaaatggatatatttgctgtcaaaatgagttatcatgaaggtataaatgtgtggacacattcagtgagcctctatattgttcctttaattaggtgaaattgaaatgtttcttttctcgtgattttcacttattctttcaggtgtggtatttctgtttgggaaagtttggattgaatcagccgagacccatgtgagctgttgtgtcatggtgaaaaatatcgagcgaacgctttacttccttccccgtgaaatggtaaacattagtgattagcttttagttctcagtcgttgtatctgccacacattctgtgttttgcagccagctctctctctttcaatagggctacaaattctctacaatcctgatgcttctttcttgctgcttgcctggtgaccactgattgtcagcaattctattagaggttgggaaaagtagaaaaaataaagtagaactcagtttttcaactagttagagtataaaagtttctgagatttagtatataatgctttctttctctcactcctcatttccataataatcagggttggaactataagtctctaaaatgtgacatggcatttggcccagttttcatggttttgctgcataggcagcagtgatattccctccattgccatttattaacaagttcaattctatttgcttctttttttttctttattgagacggagcctagccctgttgcccaggctggagtgcaatggcacaatctcggctcactgcaacctccgccttctgggttcaaacagttttcctgcctcagcctcccgagtagctgggattacaggcgcctgccaccacactgagctaatttttgtatttttagtagatacagggtttcaccatgttgatcaggctggtctcaaactcctgaccttgtgatctgcccgccttggcctcccaaagtgctgggattacaggcatgagccactgcgctcagtctgcttctccttttttattgggacttaacatccccatttccctctcagcccctccctatatcagttgaactgtggagtctcttggtcaggatttacaacacttattcttccattttgtagacttgatcatctttatcgctgatttgttttttatgatgccattgggaggaattgggcatttggtttagtacattttttgggtctgtttgtatctttgaacttatctgtaagactgctattaaatgtttaaatgggtgaggatgaaaattgatatagacttggatttttggtggttgagaagatcatttatgtacagatacttttttttcccctctgtccccttctctgggataacagaaaattgatctaaatacggggaaagaaacaggaactccaatttcaatgaaggatgtttatgaggaatttgatgagaaaatagcaacaaaatataaaattatgaagttcaagtctaaggtttgtatttggcgatgatttttttccagctctgtttgttgtttattttctgatttagcaaatagttattgcatattttctttgtgtaaaatgccttctgtgcagctataatttattgaatggaaatttcataggtatgaatgtaaaaacagtatattagatttgcaaaaatattttttctttctctttaaactgcttataaaataatgtttattaatttgaatagaaagacaatccatagcaaattaattgcctctggtgcttgcaacatgtcttgtgctctcattcccaagtgcagaagaaactgctctgatctcgtttatattagttgttgccaagatgttttggttagaaagttaagtaaggttttatttttaaaagtcagggactatgatacagtctgatagaatgaaaatctctggttcatgtgctagttatgatacattgtcttgattttagtgagatattgatgtctttggccataatcgtgggggctatagcctgctcaaaatactggctattaataatgatcgcaggaaggattgagttgctgaagataaggctaacagtattaactatttgagttttgaattgccgctgatgagtcaagtctttataattctagaagcaattgtgatatactggtgaagagcttaggtgctgaggccggactgcttgtggtttaagtcctagccctattacttactagcatgtaacttggacaagtgctgaatgactactttttttttttttttttttttgagatggagtcttgctctgttgtccaggttggagtgcagtggtgcgatcttggctcactgcaacctccacctcctgggtttaagcaattctcctgcctcagcctcctgagtagctgggattacaggcacccgccacaatgcccagctaattttttttgtatttttagtagagctggagtttcaccatgttggccaggctggtcttgaactccagacctcaagtgatccgcccgcctcggcctcccaaagtgctgggataacaggcgtgagccaccgtgcccagccgaatgacttctttatgcctgtttcttcatctgagaaatagggccctatttcaagagttgccggaagggttaaatccattaattcatattagatgatgagagcagtccttgccagatagccaacactcagtaaatataagctataattataatgctaattattaatctagcaagatggagttgcttaatatcaaatagtagcaaatcatttaatgcattaacattgtaaaaaattttaaatttttattgcccctcttgcatgcaaatatttctgagttctgtagtgtccaagatgagtccttttagcattttgacactggttgttttagttccaattgaaagaggaaagggtacctttttggcttcatttacctttgtgttccataaggattcttgatgattaaatacaagagcatgtattgtaatactggttagtttgtgaagtttttgtcttaaggattttttaaaatatctacttacccagccagtggaaaagaactatgcttttgagatacctgatgttccagaaaaatctgagtacttggaagttaaatactcggtaagtcaaacaaagaaaattactgggttttgcttgagaatgacatttttctgtttttgaactttcaactgactttcagttacgagtattggcagggcttctcaagcccacagttcattgaggtggatttatagtaatgaataattgaaatggataaaattaatttaagtatatagactacaggttacactgcctttctctgcttttgagtatgcatctttaaataaataagttgaaacagcacgactgtttgtcaagtggaatgaatgccacatgatggagttggacatcattagtctgctgaagtgtcccttatgagcagtggaaaggtgagagaggagtgtcagtagcattgctatagtgctgctcttgctcctgtgacaggcaaggtcattgctataggatgttaattaactggaccttaacctctttttacctctgttctagtgttttgttcccacaacgttggaaaaggaaaacttttaagaactatttctgacagtggtgatgaaaagtattttcaatgagttccactctgttgctttcattcttctaatggagtggtacttacttggctattctttatcagtaaagcatgtacagctctggacagaaattttcttttgggggagcttcttggcctatttttcttctaatgggtgtcatcaagatgcattattttgtcattgtgaattggttttgtttcctactgtgaattgttttggatttcatttgtggcaaattacatttcatatatatcaaaggggttttcttctgtgcttcatagagaggcttttgtttatttcaaatatagactttggaaaatgcaaagtaatagttttaaacaaaaagattctttttttttttcctttttcaggctgaaatgccacagcttcctcaagatttgaaaggagaaactttttctcatgtatttgggaccaacacatctagcctggaactgttcttgatgaacagaaagatcaaaggaccttgttggcttgaagtaaaaagtccacgtaaggaaaaatacatgctcagaatgctgaatagattgctgatagatgtggtttttaaaagggaagttaggaaattgatctatttattttaatgtgtctacttccttttctgtttgtttcttcagttttcgttgagtgagtatagggagtacatttggaatcaccttatctcggtaatgcctggcggtttagtctgagggaggccttagtttggggtgcatccctcattatgctgttattcatatgtacttctgacctggctgatgtggcccagctgttgtgcatagtgaactgctgacctttgaaggagaggagaatcactattcaatatggatagtgcatgtttttcctgttacctgatgtttttcagtaattgcttctatgatagtctgctttgtcttaaaaatgtttcatgattcctccaaggcagtgtttcagtttttttaaaacctattttgggtcctggatgctttggagaatctgatgaaagctatagacctctttcccaggaaaatgaacatatgtacacacacgtgaggatttgcatacaacccaataatgtggcttatttttagttagatgttacaatatgtcattcttattagaaggcagggttgaagaatatgccagttaatgacagatgtcttaattatagtagtttttctttttcagtaaatagctattgatctgttgtatctattctctttcagagctcttgaatcagccagtcagttggtgtaaagttgaggcaatggctttgaaaccagacctggtgaatgtaattaaggatgtcagtccaccaccgcttgtcgtgatggctttcagcatgaagacaatgcagaatgcaaagaaccatcaaaatgaggtttaaaaaataggacagattttgtacccatgccttagatgtgttacttgcctgaacttgcacagctttgctttaagagaaagttgttctttttggaggggaaagaatactaattcactactaaactcttatagagaatgaattgaatttgtctagtgttggagttttttcttaaagacttaaattgctgaacttatttttatttttgtctattaaattttttacttaggagagcttcaaatggacacagacagaataataaaatgaactccccataccaatcactcatattcagcagttagcaagattttgttacacttgtttatttccctcctttttttcttcttgaagtattttaaagctagtctcagacattgtgtcattttccctgtgaaccttggtatgcttctctcaaaatgtggtatttcttatataataccattagcacacctaataacattaacagtgactccttggtataatctaaaatacccagtccatacttacatgactctgtctctcaagatgccttttaaaactcagtttgtttgaatcaggattcacacaagattcgcagatggtatttaatctatgtgcctcttgaatctcttttaaacaggaagaactcactcctactctccagtttttttaatgacattgaataattaaagaatcattgttggttgtcttgtagaatatcccgttttctctatttatttgctttgttgtggtgtcattggacttttcctctataccaggggttggcaggcaatcaattgtctgtgagccaaatccagcctgctacctatttgtgcaagtcaaatttcactggaagacagcatgtttacagctgcttttgcactatgacagcagaattgagtagtaacggtgaccatatttaggcctgcaaagcctaaaatatttactgtctggctcttgaaagaaaaagtgtgctgaccctgccttatccttcatatttccgcatactataagtgagctctaaaggatcaaattagattcaggttcaacttttttagccaaaatgctttataggtgatgcagtgtacttcatattgcatcatatcagaagacacaatgtctggttaagctgctattagttgacaaaggctgggatcagtggaaaaaaataacctgctattagtgagtctgtgtctgattagcagttgaatgaatgataactattgtaattctccatcagtttttcatctaaggttttttaactttgacactacaggtattttgggccggataatgcttttgtggggtactgtcctgggcattgtaggatgtttaacagcatccctggtctttactttctagatgccagtagcatccgtcccctctagttgtgacaaccaaaaaatgcctacaaacacatcatcagatgtccccgggtcaggggatgtgtatgtgtgtataaaattacccccagttgagaaccactgagctaatggcttcatttattagtcatttttgccggaattagttaatttcattagaagtcgtaaaatggtgattttttaaaaattctgtccatggtttttaaatttttctataaaattaaatttttttctttagccagtattatttggttatgccataatggtttacacaggaaagacaggataaatgcttacttccttctctttaattgccagttgtcctagtaggaagttgggacctatattacatgcagtcgtgactgatgctttatttatttatttatttttgttgttatgttttaacttcctaagtccttttgacattgatagggatcttttttaacagcattttgtcagtgttttcagtattttctgatttttttttttagtatgtgttttgatctttttttctttcttttttttgagacagagtcttactctgttgcccaggctagagtgcagtgacatagtctcagcttactgtggcctctgcctcccaggttccagtgattctcctgcctcagcctcccgagtaactgggattacaggtgcgggccactacacatggttaatttttagcagaggcggggtttcaccatgttgcccaggctggtcttgaacccctgacctcaagtgatctgcccaccccagcctcccaaagtgctggaattacaggcgtgagccactgcacccggcgtgatcttttaataatagttaatactgtagatggccatagttcatagttaagtgtttgggagaagtttaattagtagttaaaattttaagaaagtatccacctctagtgtccagaatgaggtttccacattccattttcttttctttttttttctttttttgagatggagtcttgctctgttgcctaggctggagtggagtacagtgatgcgatctccgctcactgcaacctctgtctcccgggttcaagtgattctcctgcctcagcctcctgagtaactggaattacaggtgtgcgtcaccacatgcccagctaatttttatatttttagtagagacggagtttccccatgttggccaggctagtcccaaactcctgaccttaagtgatccgcccaccttggcctcccaaagtgctgggattacaggcgtgagctaccatgcccaaccccattttctaataaaaggaaattgggcgctctggagtaatggcagattcagggaaggaaatgtccaggataagtctggaacatcttattataccagaaagcaacgacagtattaaaatctactgaagatatgtcaaaaggactcaggaatcaacttgaagagtcttctactgaacaaagatgggacaatgtgagggtaagaataagttgaacagattgcaacacatcagatccatgagttcataatgatattgtctgcaatgacaccacatcgatcacttctgaaggaagctggggaaccaactcattattttgaaaactgataaagggattgaatgaaggtttttgacttttctgaacacatgctatacctcaggcaaccaaataattgatgaggggaagtttctcttcatagacggtttccagctaataaatgaaagataaatggaatagtaccactttgtaattgccggtgaaataatggatctaggaagtgatcaccagtgggtacttatatctctaaggtagagatgagcagacattatgtgcctgtgcctttggatagaagtaatcagcgcctctaaagtattcttgccccagaattgaacctgattttgatcaagcttttagacctaactatgaatttatagacagtatggagacagaaaaacaagttaagtgacactgttgggacacaagtagtagaatccatactatggggcactctctaggacaaacagcctagtttctttagcaagtaaattataggggaatgacagatgggatagggttgtacctgtagttttacatatcagccattacaaagtatggtccttgtgtggtaaataaaattgagataattggaaaatatgaaaatttaaattctgcctggataattaatgattttaagaaattactattcatgtaattgtattaggtgagataattgtattgtgattatatttttcaaacttcttatctttcagagtggtggtggttgtcagctgggtgagattttgcctctaaggggacatttaacaatgtctggagacatttttggttgtcacaactcagggggtctgggaatggtaatactggcaactagtagggagatgctggggatgctgctaacatcatacagagcacaggacagcccccacaacaaagaattatttggcccaaggtgttaatagctccatgattgagaaacccagttttagagattgatgctgaaatcttcccagataaaatgatgggtttgggttttgcttcaaaataatctagagagaggaaggaagtaggtagggttatagatgagttgataattgaaactggatgatggctatacaggagttaattttattttgtctatttttaatgtgtttacatatttttataataaaaagtttaaagtatttattatttttcgagacagagtctcactctgtcacccatgctggagcgcagtggtgcgatctcagttcactacaacctctgcctcttgggttcaagtgattctcctgcctcagtctcccgagtagctgggattacaggtgcacgccaccatgcccagctaagtactgtatttttagtagagacggggttttaccatgttggccaggctcgtctcgaactcctgacctcaagtggtccacccgcctcagcctctcagagtgctggaattacaggcatgagccaccacgcctggccaaacttttcatatgtgtttaaatgtgtatctttaaatattcttggtgattttggtgagaatgcagaatgtatagtagcggtctggtaagtgggttttttcctcctttctttgcagattattgctatggcagctttggtccatcacagttttgcattggataaagcagccccaaagcctccctttcagtcacacttctgtggtatgtatttttttttaagctggcttactaacagcttgatttgaatttccttattttttctccagctattggatcagtaacttgtttttcaaaaattgttttcaagaatagtgcatattgttaaagagggttttgtttttttttgttttttttttttttgccatggaaactaagttttattgggttggttgcctcctattcagctggttcatttttttttttctaggagaagtctggagtctatttgacatcttttttttgtttcaatggttgctctactgaggttgagtagttttttcctgggtcaaaattagactttattttctgatgtcattctaatagcctatcatagaagcttgatcaaagttttctgtgtgatgaggcaagatgccaaggaataaatatttacctatttgggaggagttatagtaataagaattggagttgggttgtgctatgcataaaattcaatggatgaaacaattccaccaagttctgcatatgtgttttatgagtcagtctccaaggaggattctgatatattccatgttgagagcttggccagttacctaagcattttgctgttttttaaaaaagggaataataccattgacctattatatttcctgggatctttttcagcccagaagcagagattaacttggcgagcctctcgtctggttttcttgggtgttaggaaagtaggactaaaacatgcagagaagggagtatgagatatgattgttgtgaagttttcccccttaagtgggtggaacacatggaacaaaatggtgatgagaatagcctggaaaatatgtagaagagagcaatcatgagttcatttcaacacgcatttattcacttcctctatgtacgtcactatgtgaacagctgttgtgtatggtaaggaacttacagtgtgtaataggggaagctttggtcaattttaccttttcagaaggctgaactgagtttctccgctgtatgttgcttgcggcattggtggtggtgggatttcctttgaggaagactgctaaaatcttccattctggcttcagtggatagatagcaaatgtttcatcaaagcagttttaacaactgcagggacttagggttctgtgcttgaccattcttttgaggtcatcaacatgaccagtggaagtatttgatgaccctcctaattctttagggttggggggaatatatttaagacagtttcgtttggaaacatgtactatatgattacctgaaattagactaagatgggtgttggaatctttattttttttcctttttacagttgtgtctaaaccaaaggactgtatttttccatatgctttcaaagaagtcattgagaaaaaggtaaagtgctcattatatgaagcatctgtttgtttggagcgagaaagaaaaggggggtggtatggactagtagaaaaaaggtgttttatattttattagattcattcctgccagattggactatgacatcgacccattaaaatgtattagacatacacctagaagcattatttaacaatgtttaaatgttttactacctgaaaataatgggattctgtactgtattggtggttggataggctcaaacccccctccaatagcttaattagaagcttctctaaaatgcatgatcatatgattcctgttttgggaaggtgttgggtagagtccctccccagcttgagggaagctaaatgaagttgggaatactgtggacgttaaagagccatgtattgacaaagttgacatggggttggccaaaatggatcagtgatctctaaattccagcgtgctccatgaagaagttttcatgggtccttaataaaatggggaggagtgggaagtagtataatgtagtgaatttttcacaaaggtaaatgtattcaattaaaagaattttcttttatggattgtatgttgtttcttttacgaagtgatgatattgatacgtttttaggtttgttttgttttttaatgtcttcatctgacaaaagtaagcaaccttgtcaggttctacttattttatttaattggcttgagaagtccagtagttgggaggtactgttagattaggctattatttgtgaagtgccgtgaattacctaaccaggtaaaatgacctaggaaaattccattagagtcaaaccgactttttttttgagacggagtcccgctttgttgcccaggctggagtgcattggcgtgatattggctcactgcagcctccactccctagttcaagggattctcgtgcctcagcctcctgagtatctgggattacaggctcgtggcaccacgcccagctaatttttgtatttttagtagagacagggtttcaccatattgaccaggatggtctcaagctcctgacctcaagtgattcacccgcctcagcctcccaaagtgctgggattacaggtgtgagccactgcgcccagccacttataattcttaaatatgtttgtttttagtctagtttcttatttatcagttctcatcttaccatttgggattattttatacaatccttgggatttctttgcccagtaaatacataaacagtgaagtctaccagggattatataggaaagtaatgtttttgataggtactctgattcatatgctctaaatgtgtccagatgcacaagcatgtccctgtggagggacatttctatattttatgttgctcagcacttaaaatattttgctttattcacatgcttattactagaatgagctcctcagagactttgaaattattactatgaaacctacaatcaggaatttcattgctacatttagttttgaaatggatggtttcttttaaccctaagaaatcttaccatagttgaacaagaagccaagatacagtacttgcggacagtaaagagtcgtcagtgactggtgtgtttttatctaacagaatgtgaaggttgaggttgctgcaacagaaagaacactgctaggttttttccttgcaaaagttcacaaaattgatcctgatatcattgtggtgagtagatgtttgatcatgttgtggggaagctcttcatttcttagttcttttcagtgtgactttattggtgcttttgagcagcaaataatcttttcagagtaaaatgatcctgtggactggtgggaattgctgctaataggagaaaaaaatagcaagcccactgcaagatagtttttttttttctctagtataaaagcaacctatgacttagtgttgaagttaaggattgtctggctatttatgcttagagaccagcacataaataagtaaacatgtacaaatggagttatcgccaaaatattgacttagtagttgtatagtggtcacaggagtttattaattcccttggtttggtgcaaatcacaaaactaagtattttaattttatgagttcagtggatctctatgacatattcctttgaaaactcagggctcggaattgatttttctcttgacgatccagtatatccccactagatagcttgagctaataattcattgagctattttttgccccaattcctgagagtcataaggcaacattttgttttatatatcctctggcctttctagtttgtagaatatggaattccttcatttgtcttttttctaggttaatggatcaatcatattgtttttgttttttcagaggaatgtaggctataaatgcctatattttggatgtgatatgggtaatttgggtacattaaagtcttgcaaaagtgtttgccgtattcttccctacattcatttttactcttggataccttatctggcaactgtatagctagcatcctgagttcctgtggataggaagcgatatctctgcacccacttcccttatgatatttcaagacctatctttaaagttccaaaaagattctgtccacagtgttggactgtgacattctgtctcagcaccaggccctcagtcagcctccaataacaacagtttcttggaccccaaggagatgccatgaagcctgggaaacctggcctggcttcaggtgttagagccaagtctatgcgtgagaaatctagatgtaagatggaattctgacatgaatatgggtccctgattctaggtattataatttgtaagtgagacttcctcaaggcctttgggtcttctaatttaataagcaaaactgctataaatatctagtggtaaaatacatataaaattaactatgttgaccattttatagtatacagttcagtggtattaactacactcataatgttatacaaccatcaccacgatccatctctgtaactcttttcattttgtaaaactgaaacgctgtactcattaacttcccattccccggcccctggcaaccaccattctgctttttgtttctatgattttgactactctaagtagtggtatatatttttaattaagtttaataacaagtatatttattgatgtgaattattttaaacttcatctaatttttgataaacataggaaagtgaatcatgttcacgtgttggaaattacggaaatgaaaaatctagttgcatttttgagataatttctactctatatagttttgtttctttgtttttaacaagtttcttatttgaactatttagtggtattatatatttatcttgttgcatatcaattatgagtctaaatcagtagtgtttgaactcaatttttaaaaagaagctaaatgcagttcctgagttttcgaagaagtcttacataaactgtcatacaacaccaggcaggttctgtgtttttaaggaagcaaaatggaattatttgaatttagcttttaccgatcatatgaaaagtatgggacattaaatttgcattttcctccgagaccgtaaggcatgagctgcaaattaaaagatatcatatgagccttgcatcaattaggatgaaataaagtttattccagcaatctgcttagcagccttgttaatgtcaaggctaatgagtgctgctgatgaataaattcctgaagaagaaaggacccccaatcggaggtaagtgcatgatgtcttcaattagagactagaaaaagaaagggcaaagaaattctgtgcgtatgaagataaatcctctaatttgcatttgttataacattatcagctgccttctttttctgactagggtcataatatttatgggtttgaactggaagtactactgcagagaattaatgtgtgcaaagctcctcactggtccaagataggtcgactgaagcgatccaacatgccaaagcttggggtaataataattttcaaaatcttatttatctatttattttaatttgggatagctaccaaggaacacactatactttttaaaacaggaattggttatcttgttatgggaacttcagtacattttaactttggcactaaacatcttttcctttgaattcagcattttatttgtaaaagcctctggtagttttggccgggcgcggtggctcaagcctgtaatcccagcactttgggaggccgaggcgggtggatcatgaggtcaggagatcgggaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaagcctctggtagtttttaaaatcattggttagaatctagggatagtgaacaaagacagcccatacatgttaccttcactttgtcattcctgaagtgatagcccttagggcaaggttgcatggttcagaaatcgttgagtgctatcatttaggaagaaaatgggaagaatgaatggaagggagttgatgttggttgtataagaacgcaatattgcttgctgatatcttgtaataaaaaaaaaaggaaaaaagaaggcaataaactaagtgctttctgtgttagttacctctcatgacaactccagttttattttatagacagtctcataggggtaacgtaacttgttctggatcatgtaagtagtaaggggaagaactgagatttgaacccaggcctgggtgactcttaaagccaatgtgtacttttcattctgcctgcttgcttcatgtatggaggttttggcagtttttgtatgaagcaccttcttcctaaacctgatactgctcagtgcttgaaatcttattttacttaaagcttataaataaaatggacatgttgcctcatcagataagttaggaatctgtacctttttcgtaatgttctctagaggattctgccactacagatcaaagttggggccactgctcttgcttcttttcttattcatatctttaaggtggtagagttgttattagcacttcatctgaacacttgcttagctttttacccccttcaagattttctttatgtggcatcttctcagtgaggtataccccattaccctatttaagatggcagtccccccgtattccttgtacccctcaccctgctgttttcccattttccatccacttgttacctcctaaaactatataatttcttgtttatgatgtctgttttttattatacatttcaaatgaggccaggaatcctttctgttttgatcactgctgtatcctgagtgcctagaataatgtcagatacatagtaaatgttcaaaaatatttgattgatgtatggaagaatgagagttttatcataattttgggccagcttcaaaataggttagaaagaaatgttctcagtgtctgctctttcatgaagtttgctttttgttcccatcttgtagggccggagtggatttggtgaaagaaatgctacctgtggtcgaatgatctgtgatgtggaaatttcagcaaaggaattgattcgttgtaaaagctaccatctgtctgaacttgttcagcagattctaaaaactgaaagggttgtaatcccaatggaaaatatacaaaatatgtacaggtatgatcctagattcttcagaattcatctgtcttgaaattaacaacagcaggacactactagtactatccttagtctggagggacatgagccagtggtgttgtagaggggaaattgtctctactactttcataatttgaactagtttacctcttgaattattgtaattgatcagtttatctccgtctccctcacctgtgttaacactatcttgatgtttcctaacagtagtttggatttagatttctactcttaattcatttattcaggaattagggtagatattttagaaatataaaaactgagcaatcattaagttagaggtattgcttgcttatttcttcctcctactcctctggccatctctcattcattcctgctagttcttcctgagttctttcttggacttctcttttctgactttgttctttctctaggtgatctcattgagtcttaggaatttaaataccatgggatggctatgcttcccacctgtgtatcttcaggttagacctccctaaattccacactcagtgtatctgttttacctattttacttgatatctaatgtgaactcccagcttgttcaaaattgagctctgatcttctatcctaggttcttcctatagtctttccttactaaattaataggtgtattttttccattatcactggaaacttccagagtcttacttagccccacatgtctgaggcatctttaattcctctctctgatatcccacagtagatgcatcagggtatcctatcagttctatcttctaaatagatctaagtctgaccacttcttttcaactgcattggacccatcctatccaagctgctatcctctttcccctggattactgggtttatatgcctatccccttacttttgcccttacccccttgtggtcgattctcaatccagaatcagagttatcctgctaaaatcaagtcagatgtgatactctgctcagaaccttccagtgactctctgtttcattcagagtaaaaactaaagtccttatttttacttacaaggtcctttacaatgtgtctctatgtcgttaactctgtccttatctcgtactgctctttccatcattctctctgatctagccatattggcctctttcctagtcctggaactgtcagatttgcacgcagctcaggacttttgaatgtgctatcctgtctgcctggaatgctctttccataaggcttgctccctcacctcttcaagatcttcattctcagtaaaatcttccactgtttcctaacaaaaatttcagtctctgcttctgatacttaatattcccgttgcttaacttttaacattatataacatactatatacttaatttctttgtttttttttatactctgtctcccccgtgaggacataagctccaggaggataggaagttttgtttgttttggtcacagccaatgcctggcatatagtaagcatgcaatacatactcactggatggaatgaatgaaaggatttaggtagttttcaggcttgtagttattatattacttcagtttttccttatgggattttgtgtgtgtgtgtgtgtgtgtgtgtgtgtgtgcgcgcgtgtgtgtgtgtgtgtgttttggagaaaagcattgggatcagtggtatgaatgaattcctagttacatactgaccttattttaaattgtttctgaagccaaggtgctgttgctctgaatttacttacacccagaattccttataatattttgtgaagttctgattataggcattgtttcttttaattacttgattctgtttcattcttacttttctgtacagtgaatcttctcaactgttatacctgttggaacacacctggaaagatgccaagttcattttgcagatcatgtgtgagctaaatgttcttccattagcattgcagatcactaacatcgctgggaacattatggtaaatttaacttagaaagggggaaaaagcatttcctgttggattcagtgtttgcttggggtagttgttatatgataatgagtctaaatgcatgcttataaaatgagtaacttggattctgaaagctggatttcttttgtaaaaggaagaactggttgggagaaggggaggaatgccaggtgcagcgtgttgaaatttgggtgaacatacggatcatctctctaacatctggatgtgtctttttagtggaatggtccatttgggagtaaataaatagccaagttgtcaatattttaagctctctttgtctcctttagctataatgcttaaagaaaacgttaggaataatttagtaccttttttttttttaaaaaaaaagcagaccgttattaggaatagttttgaaggaggtgctgtgactaaacttactgactcaaagttgcttttgttagttgtggttttgagctcaaatttaaaaaataaattccatttaatagtccaggacgctgatgggtggacgatccgagcgtaacgagttcttgttgcttcatgcattttacgaaaacaactatattgtgcctgacaagcagattttcagaaagcctcagcaaaaactggtgggtccaaaactgtgtagtattttgttttctcttaaccccccccccccttttaatacctagatagccttttttttctgtgataacatctgctttcaaaatagctaatcccttgtgtactaaagaaaccgtgtcaagtttattcccttgtttttgtgtggtcatttccttttccactttgtaaaaggaaaatgcactttgtgcagacaaaattatttgtgaaatgtgaaattctttgagggaagcattagacctctctgatgggtgaccatacatggaatgtgttctggcacctcagccctatccaaagataaatgccagttaaactttttattttcttaaacctatgagcctttatttttgtgttgcatttttctgtactagtatgaccaaggtcacccacagtcaggtttctgaagtagcctccatcactttggaactaaaacttagtttagctactgttttattagcactgatattaattaattcagaaatgggaattgaatgttagaatttgattcaggttctcatatttgcttgttttttaatgtacattatcaaaattggtatagggcatattcatttagaggactttaacttctgctgaggtattgaatgttggccagtaataaactacttaggaatggattttcagtatatggatgtacttgttttatggtgtccatattaataatagggataatgataatacctgcatgaagtattttatgtttttacatcacgaatgttagagtagtgattttaagagggctgttttataatctcaaattttatataacatgaaaagtggtatttttcaatattcattgatttaaaaatatgaaattctgtaaattcaaaaacacataaaaatagaattttcatatttgttaactcaggatatagtatttgtttaagaaattactatgcttgggattcatttggattcgtgaacatattacaataactgtctttcccaacagataggaccactaactgaaatgtttgttagaactaagtcctgcaattggaaaagagagaatcatcaaaattttaaattagttaattagttgctggctggtgaagttatctttccatttgatattagggagatgaagatgaagaaattgatggagataccaataaatacaagaaaggacgtaagaaagcagcttatgctggaggcttggttttggaccccaaagttggtaaggctgggcagtgaattggttttctcccagtattaaggaatttcttaatgtggatctaggcttgagaaactagaagactgaattatatcttatagatcagcgaataggtctcatgacttttatctttcgttcacgtgaaaatcttggttgccagtcacctgacatagacttaatgtgaattttgttatgctgtgttccaataaaatattatttatagacattgaaatttaaatttcatatagttttcatatgtcatgaaatattgtttttgatttttttccagccatttaaaaatgtaaaaaccatacttaagctcatgggtggtacaaaaataagtaggttggatttggtctgtagccgtagtttgtctaatacatagatagctgtccagtacatagatagctgtttgtcctgaccagttcagttgacagcaaagttgaaggacgtgcagacaataaccaccaaatttaactttaataggagaatatctttttccctattgtcatgaatggcaaagatgttttgtggtacacagagctagaaataatttttttttctttttttcttttttttttttggagacagagttttactctgttgcccgggctggagtgcagtggtgcgatctctactcactgcaaccttcacctcttgggttcaagcgattctcctgccttagcctcctgagtagctaggactacaggtgtgtgccagcatacccagctaatttttttgtatatataaaaaaacatttcaacccttcccaagtgtacagttcagcagtagtgttaagaatattcacattgctgtgaaggaattaatgtgaattttatctaataagttagttctgagtaggaaacatttttgacaaaagtgattttgttattagttataatgaaatggagcagtagtacttggtgttatgtaggtctgggtttgaattcagtgtgatcttgggctgcctgtttaacctctgtaagcctcagtttcttctgtaaaatagagttaagagtaatatctaccacacagggatttaaggataaattagtatagtgctggacacagaataaactatcctatatgtttgcaattattattgtcttaatagtggacatttatttttattcagtttcttctcaaggtgaagataactctttgtaaatgtcctacagaaatatagtagctttctgttcttcctttgcaagtaaaaagggtgggtcgttccactactgacatttatatatatgtgtctcttgtttgattttagctcagtttttgtacaggtaaatgtgccgtccattttattttttgaagctgttgtaaaagaataaattactctaccaggcgcggtggctcacgcctgtaatttcagcactttgggaggctgaggcaggcagatcacgaggtcaggagatcgagaccgtcctggccaacatggtgaagccccatctctactaaaatataaaaaattagccgagcacggtgttgcgcgcctgtagtcccagctattcgggaggctgaggcaaggggactcacttgaacccgggaggcagaggttgcggtgagctgagattgcgccatggcactccatcctggagacagagtgagactctgactcaaaaaaaaaaataaaaataaaaataaaccactcacttggttttatttggggtggggggtgggagagtaggtaggaggattcttcaaagaattcttgctttgaaggagagttgaacatttttttttttttaatggatgtgacacgtctcagatagctgattgggaaggtatttgctcataataatggtgtgctttggggacagctggggaaaggactggttgtagctggttctaaagagagacaggatctttttctccctcttcttttgtgatctggcttttcactaatccgcatcattttatgaaatggtagttgattctttttttccctttttgtctgtttcacagctctgggtagtgtatatggatagtatatagtttctaatatacttacagtgcttttaataatgatgttttgacaattctgcttttctttagactttttatgacgtggctttttaatttcaggtttttatgataagttcattttgcttctggacttcaacagtctatatccttccatcattcaggaatttaacatttgttttacaacagtacaaagagttgcttcagaggcacagaaagttacagaggtttgtatttaacctgggactcttgaaattgagtttaaaaaaattgcttaaagaaggaagatctgtgtctttttaaaatagttttattgtggtattattcatataccatatacttcacctgtttgaagtgtgtagttcagtggcttttagtgtattcccagagtttgcaaccatcatcacaatgagttttaggatattttcattattccccaaagaaaccttttagctgtcacctccctcaatccccatcccttccacctctaggcaactactaatctttttgcttttatagatttgtgtattctggacgtctcatataaatagaatcatacattatatggcctttcggtatctggcttatttcacttataatgttttcaaggttcatccattttgtagaatgtactagtactttattcgtttgtgttgctgaataatattccattttatatgcgtgtgtggtgtatgtgtaggtgtatacacatacaccacattttgttcttttttgtaattttttttaatacatggcagaagatgtctgtttgccctctagctcctgaatttatatgtcagttctcaccgcaagcttaggacctgtttttcaatcccaatttcatattcccagaagagagaatctgataggtttgcctaggttggtgagcactccaggtccccgttacctgtgaccacaagagtaggttcacagggcacggatctggctgctaagggtggacctttctgtgggactagtggatacttttacagagaagatactgggtagacatccccaaaaggtatgactgcattcaattaatatttgagctctgttctgctactgtgccagcatggtgataattaatattatttagcctctgcccaccaccattttgcttattggagctttccagcttggattctggatatataatagaatcattttagagttggaagggacctcagaggtcatctaagaaatactatacatgtagcaatttatagatctgaatcattttcatacatggtacctcagaacagttagtgtcacacaggtagtagttgtagagctaggagtggattgtaaacttcctgactccacatctttcagtttactttttatctgactttcatagttgctgtaaataaattagaatgtgtaccaggatctctttaatagatttactatcatcatctgttatattggaaaacagtaggtccctattactattgtaacagtgttcacttgaagatattgatctctataaaatcagatgctttgtaaaggctaggttatcaaatggcattgacttgatgtactttaaaccaagaggtttatttttaattctgaacctttgaaagggcaaatgtgcctggcttttttctttgtagctgttaatagaatttacggaggctagggaaaaatggtctaatgcttcccctgctttttcttcctgtaaattttaatataagaagactgctggttgcttttctgaaatgttgctattcttctgccgattgcatagcaatttataggtaaaaggtactacataaatgttaagggatatgtatgtattagtttttagaaatgtcatggcctatttaaatgtgctccaagctccttttttttttttcttttttttttggagatggaatttcgctctttttgcccaggctggagtgcaatgttgtgatcttggctcactgcaacttctgcctcctgggttcaagcaattctcctgcctcagcctcccgagtagctgggattacaggcatgcgccaccatgcctagctaattttgtatttttagtagagatggggtttctccatgttggtcaggctggtcttgaactcccgacctcaggtgatccacccgcctcggcctcccaaagtgctgagattataggtgtgagccaccgctcctggctgctccgaactcttaaatttgctgatttattagcttttaattattagtctacagcatttacaataactgctatgattctccatagttttaaaattctatagcattttgtttggtagtaaaatgatttaaaatagtagtttagctgctagttattttgtttttttaatcctggaggtctgtcttagtgtttgtattttaaaaacaatttccccaaacatgttgttctccagttttgttgaagagagatagcatgtgtaaaaatgtatcccttttttttttttttttttttaagacagagtttcgctgtgtagcccaggctagagtgcagtggcgagatctccgcttactgtaagctccgcctcccgggttcacgccattctcctgcctcagcctcccaagtagctgggactacaggcgcccgccaccgcgcctggctaattttttatatttttggtagagacggggtttcaccatgttagccaggatggtctcaatctcctgacctcgtgatctgcccaccttggcttcccaaagtgctgggattacaggtgtgagccaccgtgcccggccaaatgtatccctttaaatgaaatctaaatttgtgtctaactacaggggtgggagatattgggaatgacagcctaatataattgggagagaagagggcaatcatgacctgttctacaaccctctcagctctttcttatactactcatgcattattgaccttgtataagataatagcttttcaagatgtgatcatgggggaaagctcctataaaatattactgtagaaatttatttcgcaaaagtttgatttgtgtgaaatttgttgtgtgtttatcaggatggagaacaagaacagatccctgagttgccagatccaagcttagaaatgggcattttgcccagagagatccggaaactggtagaacggagaaaacaagtcaaacagctaatgaaacagcaagacttaaatccagaccttattcttcaggtatatcttttcactaagaaacatttgagtgacagtctcagcttttacagtttgattatttatgagtaaacaggatgctgggcaattgcaggtacttattttaagtttgtggataggtgaccatttaaaaatactagagtgcctcagaatggaagccacctttgtttacaaagattgtatctgagcaagatacttctggctcctgggagctttggagtctgtgtttacttgctgcttctaggaggttagggaatcatggatccaggagaatgggttgagtatattaattcttttttattcagggatattgagggtttccctttttattggagatctagaaagacatctaatgtaatgcttaaccatctgtaaatgttgttgtttgtcttttgttctgtgtggcctgcagtatgacattcgacagaaggctttgaagctcacagcgaacagtatgtatggttgcctgggattttcctatagcagattttacgccaaaccactggctgccttggtgacatacaaaggaagggaggtaaatggcgtaataacattcacatctctagatatgagagtatttttaactatacatgttatagtgtgggagagtcaagtttattacctagttgtacagcatcaaatacagtacccctctctttggatgacaggtttgagacaaataggcatttaaataaggtttcattaattcgtgtgtgtgtgtatttattattgaacatctactgcatgccaggcattgttctaggttctcaggatagagtgtcaagcaagacctaaacgatccctgttatgaggcttacattctacccagaatgggaggggtttggggttggggacgacatgggttgggaatgtggggtggtgagagggtggtttgggaaaacagactttaaataagtaaataaacatgtataagaaataacagaaaatatgatagaagtaaatgctctgtagataattaaaacaggatggtgggctagagaatgtttggatggctggtttagattggtcagggaaggcttctttgaggaggtgacatgaatgagaatgacttaagagagtttttttttgctgatggattagcttggagtgtgagtgaaaggtagaaatcaggaggataactagtagagccttttactaagatggaggaaactgggaaagaaggattaagaattctgtcatggatgtgttgcctttggcatgagtaatagaattccagacataataaggaggccattggatgtatagatccagaattccaggaatacatcaagacaggagttatggattgagagttattggctttaataagatgggccagataccaaatagaatttaggtacatcactttatggacactgtaagcttcaactgttttagtactatgtgcatgggtttttcttaatttgtaaaagaatagttacgctgaatattaaattccatttaactccctgtctgtgggtttaagactatttagccttaaaggaggtaggtagtggtcatgggaaaaatgcttatattggggggtctgtactctgaatgctctagagcagtggttggcaaatgatggccatcggggcaaatgcagcctgccatctatttttgtaaataatgttctattggaacagagctaaactcatttatttatgtatcatctgtggctgcttttgtattacgagagcagagctgagtagaaaagatggaggctcacatggcccgcaaagcctgatatatttactctctggtcttttttagaaaaaaagtttgctgacctctgctttagagtttagatcaactctgtccagtagaactttatgatgatgaaaacgttctccatctgcactatccagtgctgtagtctctagccacaagtggccagtgagcacttggtatctggctggtgccaactagctgaggaactggatttttagattgctttaattataattaaaatgaatttaaacttaaatagacaaatgtagctagtggctactgtgttggacagtgcagatctagctggtatatgaaataaacgtcaggatgttcagaatcactcttctgttggcagccgtatctcaaagatttgtcttagggcacagtgaggaagggcaaaacatgtattgaacgccagtgatgtgatagaagctttcctatgcattatttcactgaaattacacaagaatcctttgaaatagataataacgttttcattttttagatgaggaagttaaaactcaaggagataaagtataacaagtggttattttgaatgtaaatccttttagtacagtagggttgtctcttccatctcaagatgtcatttatgactctggttctgctttatattcgacctcttattacaggaagatcatgatttttggtacccatctcaagacacaggtctctttttacatgagaaagatataggtgttttaggggctagttgaagtgagggaagggaaggatgctttcagtttcttaagctaagtttactttaaaattatttaaattttatttctttacaagtatccagtggcttctgatggaataccatcttatttttgtattagaaaatgcactcactatgccccaactgggtgataatacatgggttgactattgagattggatcaaggttactcttaagtttctcacgagaggcaatagttgacaatttactcccttggagagtgcctcttgctgctgggaaatccctgttgttacattttccacattggctcagaaatccacaagcttaaaagggcactgttgataatgataagccccaaatttgtccaatgatctcccccactctcctaatccattggattttaagggcaatggttttctttagctggatttttaatagcgagtttaaacacaattttaatttttctgttatataaaatataacaataacaaatctttaataaatgaactataaaaaaccctgttctctccactaaaaaacaaaggatttcagacgaatctagaactacttgtttgtgatttaaattcttggtatctgctttcctcttttctctttaccctttgctgtttccctcaaataaggataaataaaactctggaaagtaggcctttaaagtaatatgaggctactgagaaataataattacgcagtttctcccaggaaatcttattctagaagaagatccaaagtcacttacaaatattatttcctaatataaaaatgatttttaaagtattggtgataattgttagcactggtggatggaagtagtctatgtgatatctttctttgggttagcgtctcttaattattaaagaggtaggaggagtgaagtgaaaatgagagccagtgtgctgagattttggaatacctttgtaacttattaaactagtattttttgtgacaagatacgagtgggcagaataatatagtaacctgcagatcttacaaattctttgcttttaaagtccttgtgggataaattagattaagtttcaagtggaaattaatgagaaggaaacctggtagcatgccattgcaaaagattataaaattttgcatttggatgtggattaatacacagcctagggaggccttgaagcccccttttcctttttatttttaagtctattttgtgtttgctcagttttcctggaatcgtgcacgtttggctctagcgacctaataatttctgtaatcaaatgtattatggctgctagaatactcagagtaattactaattgtactttttaaaacaggtttataataaaagtgctagtagttgtgtcaaatgggcatcaatattgtcttttcacaggtgtgatctttcacgcttaaactcttccatgattttgaattgctttgtggtagaggaatgagctaatgggtaaggaattgtatgagggatctcacagtgtgtacgttatttaaaagtaatgaagtcagtgtttcagagtactctgtggatctatagaaataccatctgtatttgtgtttgttctcaatgtgtgtgtagagaggcataaaaaagaaattgggcaagcctatggcactgagtggacatatatttttaaaccatgaagaaaaggggtatcagttgtcaaatgtctgatgtggtaattgaagtgattgttcactagatggcgatagacaccctgagatcattaatcaattaaggattttattctgtgaacaatagtgaaggcaatttaatgagttaaatctgtccacattttagacttttattaattttggaactattaaagaaaagctaaaactggcccaaaggattgtaatactctagtgtttaaaataattatgattttttaatcattagttatattgataggaacagtaatttatcatagcaagttaattcttctatcgagtagctaaattctgatttctggccatggagacacgatacatgactccctcagtcacagtatcagaagctaatctaaagggaattggaaatgattttgatatatgattttgcctttttgaatttgtttttttattgcgaaattttttattttattttattttatttatttatttttgagatggaatctctctctgttgcccaggctggagtgcagtggtgccatctcggctcactgcaagctccgcctcccgggttcacgccattctactctccctcagcctcccgagtagctgggactacactacaggcgcccaccaccatgcccagctaattttttgtatttttagtagagacggggtttcactgtgttagccaggatggtctcgatctcctgacctccggatccacctgcctcggcctcccaaagtgctgggattacaggcatgagccaccacgccaggcctattttattttattttattttattttattttattttattttattttattttaagaaacagggtctcactttcttgcccaggctggagagcagtggtgtgatcatagttcactgcagcattgaattcctggactcagacaatcttctcccctcagcctccctagtagctaggactacaggcatatgccaccatccttggcaaatttatttttattttttgtagagatggagtcttggtgtattgcccaggctggtctccaactcctagcctcgagggatcctctcaccttggcctcccaaagctgtaggattatagataggagccactgtgcctggctttattggggaatttaaaactgactatgtacttataagtatactcattgcataactttagtttaacgggaatatttgtcttgatggaataattagtacttactgacattggtattattttatttctctactctcttatttctgtgtccttgagaaagccatttttggtctggattttttattgcattttaaaatgtatgctctgatgtttaggtatagagtccatgcattttcattttcctacctgataggctgaaataagctttgccagcctgcttgccagttggtcgtagactgcctggcttttagttgtgttggagctggaatttgtgcacattaaaagtgtatccaaatcattaatgcaaacattacaatcttggcaagcctttctgggattttcttggtgatgtggtagcacctatcaggatcccttgggaaatggcactaggacagagggctctagcctttgttgatgttggtgatgaaagagaatgagtgactatgaagaattttacaattaaatattaagagaagtctttcatctttacctgtaaataaccaaaaatttcacttttgcaatctttttctttctttctttctttttttttttgtggggggcaggggggcagagtttcactcttgttgcctaggctggagtgcaatggcgtgatctcggctcaccacaacctccacctcccgggttcaagcgattctcctgcctcagcctcccaagtagctgggattacaggcacgtgccaccacactcggctaattttgtatttttaatagagacggggtttctccgtggtcaggctggtcttgaactcctgacctcaggtgatccgcccacttcggcctcccaaagtgctgggactacaggcatgagccaccgcaccccgctgtgatctcttaatagcctagtttttctttaaaaaagtaaaagcaataaaatattatagagacaactaaagaccatttcctccccatcctctctcatttctttttctttttcggaggtaacttgcccagagttggttttgtcattcttgcccatgggttgttcttttttgcttctgcaacgtgtatatacatgtggtgtgttaaaagtttttaccatgtatgtgtcatgctatacatattcttttgcagtttggaaaagcaggagaaaaactctactctgtatgccacattttaagtatattcatcttgatacatttttagatttgattcattcatgttaactattgtataatatttcgatgaatatagcacagtgtattttttaattctgccatcatccatatctttaggtttccaagttttcatttgtcttaattatttgctgttacaaacagtactgaagtagacaataccacctttgtgagagtttctctggtatatttctaggagtggaatttgtacaacatccacagcagtatatgaggctttattgataagagcagccatttaatttatcacagcaagctcatttttaaaaatcaagtagctaaattcatatgtctggctggagccacaatacgtaactccctcagtcacagtgtcagaggctaatcttaagagaattggaaaggattttgatatacaattttgcttctttgaatttttgtttagttctctgttgaggcattttaaacttactatatatatacttagacttgttgcataatccttgatattccacatccttgcagcacttattatctgagtttttattttttggtcagtctcatgggtatgaaagggtatctcattgtgattttaatttacattttaaaattattagttaagttgggcatcttttcatgtgtttattaactcttccattttcttgtctgaatagaacatagatgttctattttgttggattgtatgtctcttagtattcttaggtattcaaaagccaatccttgttttgtcatttgtgctgcagagatctctttcagtctgtggcttgtccttttactttatttgtagtctttcattatgcagaagtttctaattttaatgccagatatttaattttttcctccttacactatgtgggtttttttcccacaagaaagctttccctcctctagtgacgtagacattctcccctgttttcttctaaaagttgcaaggtttggattttcttatttaggtctttaatccttctagaaattatttttaggaatgatacaagttaggaatctaattgtacttgtttgcttccttgtagagttattgaacgttcctgtattgttcctgtattccaggggttggcagactttgacccatgggctaactcaactcaaaactgcctttttttgtaaattaagtttgattgggacacagccctacccatttgtttatggctgcatttgtgctacaacagcagagttgagtagttgccagagatactgagtgaactccaaagcctaaaatatgtcctatctggctctttacagaaaaagcttgcaaacccatggtctaaaagatagtcatgaaagagtagctcatatttccaacagtagcagatatagtcagtgaaaatagaggaaattacactaaaggttgtaagaaggaaggaaaacaatcttttggacatgtaaaaaatacaaagtttgggccgggcgcggtggctcacacctgtaatcctagcgctttgggaggctgaggcgggtggatcacctgaggtcaggagttcaagatcagcctggccaacatggtgaaaccccgtctctgctaaaaatacaaaaaattagccgggcgtggtggcaggtgcctgtaatcctagctactcaggaggctgaggcaggagaactgcttgaacccgggaggcagaggttgcactgagccgagaccgcatcactgcacaccagtctgggcaacagagtgagactccatctcaaaaaaaaaaaaaattgaaattttactgattcttagattgtcatatgagaacttccctcaacccaagtagagtaaaggggaggtctgtgaatcctctgaagttgtatgtaatattttgtgtgtctgtgcatatgtgtacttttttggaggagaggatgcatagcatttaagagactcaaaggggaccatgatgtgaaaaatgataaagaacgctggttcttatgtttcatttctggcctcttatgtaacttgaggggaaactttagccttaaaaatgtatacttttgtcacctaaaacatggcagtgcgaagaattttcttgccaaaccagacccatttaaactgtgtgggtggtaggagggatgagttctaattctgtctccagaatttttatagccaccattaagactacttttaacttcagctgacctactaacattttgattttttttaatatgagaatttcttttaaggctaatatgaaggtttaatgtattttggcagacatattttatgttaaaaaaaagcaatatcctttgttagtgatcatgaattacctatcactttcaaagttgcttacattataaaatttgaagccagataatttttaaatttcgtttctattgtcatatttcagggatgtttggattctaaattcccggcagttcttcagaactgataacacatactattcagctttattaattcacattctactcatttagaatttgtggtaattcagatggaatgagttgaaattcttcttagtacacattaatagttatttcagagcctaggttcttttcatataccattaaaaatacaggttgagtgtccctaatctaaaaatctgaaatgctccaaaatctgaaactttttttttttttttttttttgagacagagtcttgctctgttgcccaggctggagtgcagtggtgcgatctcggctcactgcaggctccacctcctgggttcacgccattctcctgcctcagcctcccgagtagctgggactacaggcgcccgccaccatgcccggctaatgttttgtattgttagtagagacggggtttcactgtgttagccgggatggtctcgagctcctgaccttgtgatctgcctgcctcagcctcccaaagtgctgggattacaggcatgagccaccgcgcccagcccaaactctgaaactttaagtgccgccatgatactcaaaggaaatgctcatggagcattttgtatttcagatttttgaattagggatgctcatccagtataatgtaaatattccaaaattccaaattcaaacactctggttccaagcatttcggatactcagcctgtactgtagaaacaactatctacatttaagtaagtggcattttatctgcagatcgtttatattgatgaacttgtactaaggaaccatctgtttgcttgtccatttgtctacattctttcaaaaattgatgaaagtaatgttggtactttcaaataaaggtgaaaaaaggaagctgtaatttggaaacaccccatggaagcccagtccagattataacttagactttcagtaatttgagagaaatgcgatgataaaaattcaagtatatagaataatttatgcttatatatgcttgcattataataaacaatatatacttatatgaaaaatatatggtaagcatataatatatatgttatatataatctattataacagtgttgcatttatagagattaaataagtgggttacacttaggcttgattttaattactctatatgcttgaaaatactgagtatttctttcaaaatggctaagatgttagacttgagacaaattcagaataaccttattcttctttcttaatagttggaaactagcatatctctaagatgcatggatattggcctctgtgtgccttttaggtttttggacattgaaaggtacaggtttaggaggacacaagccagttgatgtaagagacagctgggaagagaaagactaggtcaaatcttgcctggggtctgtgagtgtaagagaagaaagctacatcaaggaggccatttagccatcttttgtttatcccctttgcatttgctgaagttttttgttttttgtttttttgtttttttgtttttgagacggagtctcgcactgtctcgctggagtgcagcatcgtgatcttggctcactgcaagctccgcctcccgggttcacaccattcttctgcctcagcctcccgagtagctgggactacaggcacccgccaccgtgcccggctaatttttttgtatttttagtagagatgaagtttcactatgttagccaggatggtctcgatctccttggcctcccaaagtgctgggattacaggcatgagccactgtgcctggcctgcatttgctgaagtttttgagtggtcaccacatcttagttttacctgtgctttaaggaatccaggtgtgggcacccgcacccctctcctacacatacattatactactaagtgtcaaaggtaataagatatggtcctggggttgtgagttggcctttccagtcttgctgaatcttcagtcaatactaatctttaaaattccagggcttctttcatcaaggaagatggaatttccttattctcaatccaaatttgtgcctttttccacccatatattggatttcttattactagatttttcacatgggtctgcataaactagtatcaatacttaaaaattttgtattaacacaaaacaaaagtctgcagcctcaaattatttctgtattctccaacctctacttcagtttgtcagggagtgcatttcagatgtttttttgttctacctagcccctaagccctgtgctctacatagtggatgtttgtttgccttacctctgggatcacactcacttggtagtttctgtagttatagatgggtagatagggaagtggtatattttttaaagaaggtcttgatatttaagcctattttgaatttataagaatggccaggatactcaaacaagaaaaaggataattcgtacatttgtagtgggaacctaggaacttttatctgaaaagatagggacagagtatttttgccttgtaattttgcctttttaattactgaaaccattgggaatgtggctaaggatgagaagataaatgctattaagactgaccttgtgtcagcaccactgatctctgctgagatagattaagtttcattactttgactagaatcacataaattgagtcctggaaatctttttcttccccacccctcaccagaatgagtgactttgttaacccaaattcattccatttttctccatatgtgaaaattttaaataaacctattttggtatctatttctttttcacaagccatgtgttatttgacaggtgttttgaagcccttgctttggcagtgaaccaagatgacagagcagtaatgatttggaaagtgccattccctccttgttaagcgataaaaagaaaagtgtgaagttattaaccactattcaccagtggcatagaaatcggtataaggtttaattgtctggttctacagttggtctaggtaggcaatttcctggatagtgcttctcttaaggaaagggaagaataatcatataacttcacttttttctcccatataatttttttttcttcttttcacaaattgcagatagatggattggagagaaaggatcactagaaaaccaaaatattgacctcacaggctttccctttcctcatctgcccaggtatacatttatgggtgacatggcagcactcagcaacattgcaaatttcccaccccccaaatgaatcacatgctcaagtgtttgaatctgatggtgtacaggatgttaccacactgtctccttatgttagccatgctgagtctatttattgctaattggaaaaacctacttttggcagcctcggctgcctggtggctttagcatacccgtcacaacagtatggtcagacccattaaagacacatccctgtcaaatttagaaaacaaaacaagctcattgggcttgttatggctcaggaccagctgactgagggaagactaatagaattagtaccttctgtttgtgtgttatcattgcagtgggcagcatgagcctgtgtcaatttgccagatcataaatactgtgttaaattacaatgaactgagattggtaagttgtgggagttttggaaggcggggagaagaatagttttatgtatgtgtgaagaagccgtttgattttcagccagggattcctgagccctgtggtcatggttttagagatcttagacttactttgaaatttagtaccagagtcaggttgtgcagctgtccttgtttcctttttattgttaattttgtggttgaattggcttgtatcccttttaaacttgaatgtatgagtctcaacattaaaattttttctttgaaaattctgttttaaaaagcaatatgaaatagaatgtagctgaaaagtgaatttttactcacatttttaaaagagcaacaaagcatgagtgatttccagaaatggtttctgtgtcatctttggaattcttctaattactaattcttctttataggcttgggtttgattttgtattacctgtttttattggctttgttgttttacatttgacaaaagatttgctgttttgaggctagtgatgagattgatttatttatttttttatttattttgccttaggactaagagttgagcggagatgggagtggaacaaagatattaggtttcttttatgatttggagtgtcagacatttggctatatttgtttcatgggtttttcatcgctgctgacttaaccacagacgacattttcagccctgtgcaggagggtggtgtgccttctgcaggcagggaggaggagggttggggtgtggtggcttagagaaaggaatcagctcatgggctattaataatgtaaattgttcttgaggccacatgtaacatttctgagccctgaccaacagggtagggtgcgtgttctatttacattggactgcatggcacgatgtgatggatagctgataatcacaggaaaaatccgggtatttcttctttaatgatgtcctgatagggcagaaaaaaataatttgtcttcagaagattggcttagagtggctgaatatatttaattcaattactggttcttgcctcatagccaggaattcttcaagtgatatttgctgagtgtgtacatggagggaaatggagacaaatgacattgcttgtgacccactgccttgagaggaaagccttcggtaatgattccagtaaaactagagctagagcttgggaagctaaacttgtgattacttactagtaaacaagagaaaggacctgttgtaggtgcaaaaatcttactgaaatgcctgagtatgcactggagaaagccctggactgcacaccaggggtgctcacccacttgtttactttttgtggctttgagcaagtcatccattctgcctttggtttttcacttgtcagaggggtgctagatgatgataattactgctcagtgggcttcagttacaaagcaccttaacatagagtagctatctactgttgtttctcagaacaacccaggggaagcattcgtgcaaggctccgagtacctagcaagtgtcaggcatgccacgtggtgctgctgttagggagacagtggtaaacttaagcattcaaggaccttgtcttcatggagtgttcagtccattaggtgagagctgttaatcaaatggtcaatgaataattatgtcattctgaaagaaaataagtgctaagaaaaggcacatgaatttctgagtcttgatagcaaaggcccttgacctggactgaaaagtcaaaattttcctgatcctttggtacttgagctgagatctagaaagtgtgggctggagttaactaggtaaagagttggaagaataagcattctagagtgagggctagcatgtgtagaggtcctgtggtggttggaagcattatgtggccagggcactgagaaggctgaggtagctgaagtatagaaaggaaggggagagtgataggaggcaaggctggaggggtaatcaaggtcacaccatatgggctttgcaggccacgttgaccaagaggcagatgttaatagttttttgggtttttttttttgaggcagagtctcgctctgtcgcccaggctggagtacagtggcatgatcttggctcactacaatctctgcctcccgggttcaagtgactttcctgcctcagcctcccaagtagctgggactacaggtgtgcgccaccactcttggctaatttttgtatttttagtagagttggggtttcaccatgttggccaggctggtctagaactcctaacctcaaatgatccacccacctcagcctcccgaagtgctgggattacaggcatgagccaccacgcccggccagatgttaataggttttatatgttgggggagattggctcacatttccattttgagaagatcactttgcctcagtgagttggaggggccagagtggatgaggggaaactgattagcaggctattattagaatagaattccaggcaagtgatggtggtagcttgactagtgtgatggcagtcagtggagggaggaggacccagatatgagagagatttaagagaaaaagtatcagtaaaactgggtggtatattggatgtggggcttaggatggggaaggtatcaaggtcaactcttggctgacttgtgtaggaagatggagtacctttcactgagatgaagagcactggaagatgaccaggtttggggcaggaggagggaaagatgaacagtttgatcgtagacatgttaattttgaggttgcagaatataaactggggagtcattggtttatagtcattgttaaatgaagccatggacatggatgagattactttgggagagaggagagagtggaaagagaagtgggtgtaggactcagtcttaaggaaccccagcatttaatgacttggtagaggaggacaggctttaaaaagtagaccgtgaaagagcagccagagaatgagaagaggtgggaaaacatggtgttgtgaaaccagtgaagagcatttcagggaagtagtaggcaactgtcaggaagagacactgatgatagttttgaaaaatttccattgaattttgggatatggaggtgatcttttactttagttggtgctgtttgagtgcagtaatggtggtcagactgatttgctataggaagataatgtaattatccatagtttatagatcaagaatctgaggcacaaggaagttacttgtaaaacagctcacctaagtgtcagaactggaatccaggctccctgttctgtatacctgctacctacagcttactgctttactaggtgagtgtgtggactgaagaggcaaacacagctgtgtccctgttttgcttctccctgagttgggatctattaactagttacttaacctcattgaccctctgcttcctcatttttaataatggtaaatgcccggtgaggttgttgggaaaattaaatgagataatgtgtgttaatgccttgaaatgcgtttgatacataataagtactcagttaatgctagctaaaaaataaacaaccttctaccgttctgtctgccctctcctcagagcctcttacctccaattacatttttctcttgtttaatgcttagcagtcttctctaaaaaggccagtttgtatgctatttgcccagttatttttcaagtttgtgtttttactttgccatttctcctgcttttagtgcctttgtccacctacaccactaatttctgtgtagtgtaatttctgtcagtcttcctcaaaactcactttttatgactgatttaaaactgattttcttcactctgcaacttaatgagctcagcttatgtttacatttgtttcttcttaggagcttgatattcatgagtttgcgaagtttgttcactcagttttactaaatagattcaggggccaggcatgttttttcatgtccttcagcaacatgtagtagaatgctttaaagtagtgggtacaaaatggcaaacagtatttttatgctatttaagaaatagctctttcctgtcactttcttctcattacagtcgtaaggtgcagttattactaagtcctgccagtgttacttccaaaatattcggattaatccatttctctccattgacactgccactgctctgattagtttagaccaccatcatctctggccaggatcactgcatcagcctccctgtggtgtctcccttctactcttgtcccccccaatctattctcaaccctatatttttaaggtgtaattgcatcatatcattctgctttgattcctcattgacttcctatttcagtttaccttggactccaaggtcctacgtggatcacttcacctctccttttacctcatttttgtgcctcctacctgctgctccctcacctgcacccctgctttagtccagccacatgggctaccctgttctttcagttcttcacacacatgaattctgtccctccatagggaccttgtgcatctggtttcctctgcctggaatgctccttcccaggcttggtgcagggttgtatttttctctcttcaggtctcagcttatatgtcaccttcttgtgtgtgcgtggtgttttttttgtttttttttttgtttttttttttgagacagagtcttgctctattgcccaggctgaagtgcagtggtgctcttggctcactgcaacctccacctcctgggttcaagcatttcttgtgcctcagcctcctgagtagctgggattacaggcacgcaccaccacacccagctaatttttgtattttttgtagagacagggtttcgccgtggttggccgtgctggtcttgaactcctgacctcaggttatctacctgccttggcctcccaaagtgctggaattacaggcgtgagccactgcgcctggccttatgccaccttcttgatgagacctttcctgactactctttctaaatagatccatccagcacaccgccatctctcatttttaaataaaaaattttttctcactaattttatagggtgaaatatacccatgtgccaattttccagaattaatacatgttaagattttgtcataattatttcagattttaagtaaaagagagcattacagatagttgaggttggtaatgtgtgcccttccccagtttcctcctttcctctccagaggcaactgttatgaagctgatatgtatctttcctttttccatgtttttgttacctatgaatgtgctcacttaatttatgtggatggtatcttatcatttttcagtttgcaacttttttcactcaacattatatttttgagtgatatccatgttgatgtatacatatctgatcacttatttgaactgctgtatagtattccatcatacaaatattctacagtgtatttttccctttctcaagtgatggtcatttagattgtcgtcagtgttttactgttatgaaaagtaagcattcctctacttgtctatttgtacacaggtgcaagagtttctctgtcatgatcttttctagctcaacaccctgtttcattcccattttggcactcatcattttgtaatcactgacttatgtgtttgcttgtttatatacatcttccttattcagctgtgagctccattggggtaggcagtgtgtttaactcactcctgcaaacacagcccctagcatagaccttgacacatagtaggtgcttcgttggtatttgttgaattaagtcagctacctgctttccatctgttttgtgtagttcattcctttggtttttgagctttggttttcagatttctgaagaaaggtgaagactgatgaggtgagttgccaaattctatggatagtgattataggtgattaggtaaacctggcatgggaaggagctgaggaaaaaaagctataaataatttgttttggtttaaacaaaccaaaatctcaaaatttggagatgatggttggcaaggaactatgtgtactagttttggttattgaaggagctgggtttatcagctgtgggctccttccacatctgtatcattgccttattattataggattttggagaggggtgggaggattttgtgtttattttctaaaattattctatgtgaaaattagaaaattagaattatggtaggtgtaggagatatggatcgtagattaaaaagcatgagaagaaattgggctgttgatcttaaagcaagattgtttaaatcaattagttttttaaaattctcctttttattagagttcactgaatcagtgcatgtgttctgtgttttctgtttgcttttgaagctgttcagtgttttccttaccatcatagacttcagatttaactacttgatgttcacctactgaattcacatgtagagaggaaagacgaattcacgggaacaaacggatttcttaaaatggagattgctgctataatcacactttggacctctattctagtacaggacatctcattttatccactagtagcctgtgtaagccatttgctgataaattgaatcactgtaattatatttgaagttagctattggaggaaaaaatgtagctatagttaaatactatggtaatgcctcctaatttattctttttcattttggagtatactgtttctcccctcctccactcagtttagtgtggcacatttgactgcccgccccccttaggttgggtatcagttatgaacttccagagagaattaggatctggtctcactgtctcctttgcatgtaaatagtaaataattagacatgcagttaaattggagacaataatagctgagatatattaagcatatgatcctgttagacactgttctaagcactttatatgaatagtaaacatataagcacagtccaaaaaatttttttctaactgtataaaatgtaggagtcatgttattttgaggtttatgagaaattgtaatcttcaatttctagttagtggaggtgggcgtggaggagaaaatgtttgcatttattacatgtgtagaaatgtactgaactgagaaaatctaaatggttacaggctagtcatttcttagtatcctgcctattactcatccactcccttggtaaaagctttaccctgttcctataagtgggagctgggtggaggatgggaagcaatcctcaattgagttagatctgactttgcttgattgtgtggcaagttagtatggggttttatgtcattattttatttcccttttatagttgagagaactgaagtacagaaagtataagtaacttgctcaagatcacagagctagtgaataaatggagccataattcaaatctaggcagtccaagcattcttaactgccacagtacattgcctgtgtttttgagtatttgcctgtgcaacaggcattaggagatgggagaaaatagtgttgtatcttcacagtacttggagccatttttgtttgaaaggatgtgtactgtattagtgtgtgtcatcctgggttggttagcatttgctgccactttatagattttctgagagcttcaattttccttttatatttcctcagtcttttgacagcagtcataatggaatttgaatggtcatagttaatgtggcctttggaacagaattcttaaggaagaggattgggtgatgaagcaagggtggtaagatggggaatgaggaggaattctttctgtcgtatgtattttgtggaataaaatagtgatgccatgcaccacagctcaaacttggcatggttctggaagatgtctttgtgtagcctgtctgtaccactcaccatctgttataatggtgaaggtcataggttgtttgccttaagcagaataaacaaatagatacagaaaatgtattcagtaatctttgcttgatgagcagaagctagcagttgtttaaaacaagtgaaggggataaaaactcccctaacttttatttaccaatcacatcgcaaagcaaaaatagcctatttttaggctgaggctccaattatgttaagccttgaagataatgaaacagtctgacacaaaagagtgtggtgacgcaagtttgtgtggtgaaattccaagacactcactgactttttaggattctgcacggtgaatattaagctcctaaagtgtttgttgcccggaaacagcgctttattcttttacatgcagtgtaatgaagtgaacctgtgttgtaatttgtttcttgcaaggaaaagggagaattaacacacattatctatctttgtgtcctgtctttggcctcttgtgtgtcccttttatgtgctgaagccaccaagtcatgctattgctaatactgcatattaccttctgttttagccactctaatttttcttaatgctttacacagtaggggtttccagtttttcaactaattttgtattgtagatttcaccgaatttggagggtttttcttttctgtcactttttcctcattctatgtaagaattactcttagcttttggacccgttcataatcatgtcaggtgatgtttttccttggaactaattagtttcgggggtttgaaatatgtgctggcacggggtttcattggctggattaatggaagttggccatttgtgctctcccggtctcatgttgccctttctatttacaggttggtaatgggcttctgggtttttattctgctgcctgtagtcttcttgaaaatgaacctgaggtgctgaattctcatgtgatgggaagtgtaatgcttccttccagggcagcctgtcttcttaattcctgaatcttgctatagcctaggtcccaaggaatcagattcctagagtcaggaggttggtcatcttccatttggtctcagaattttcctttccaaagagtagtcataagaactaaatgtgggaaggcagaaggaaagacctatcaacatcaaggtgccaaagttacaagcctctggcattggtggttcatggcaggatttgatgaagttggggagggaaggggacttgaaggggataaatgaactcctcattagattcagattgaagtgcactgatgtgacctgtggaagagctgaaaacataaaatagcactcaggtgattgataaagacagcctggttggatgaagtggaagctaggaaatctctggctgggtgcctgctatccacgtacagtacttactctatttcatttaatctcctgcagccctgcgggtgggggctcttatttctttttacaaatgaggaaaaagtcttgaagggattaagtaaattgccaaggcctctttatttgtaagtggctaaaatgaatatggcttctcacatttgtgccactcttctgaaatacaggaaacacagacatcaacagtatttatctttgtatgcttactaaggaaaatactgtgtggtacaaccactgaaaaggctataatagcttttttgttattgcactttaacagagagctctttcttaaaattacagatttttaggaccaaattcagttcagtcgtctggcctactatgtgccaggtacagtattgaatcctggggatatgaaggtgagacagaccatggtccctggtccctgattatagtctgagttgggagtagaggtggagggaaaggaaagaaattgccctgtgaacaaattccatgccatatgactaaggtaaatttaaagaaaaaaggaaaggtaaacattgcctagagattacagaatgatgcccatgcccacagaatatctcttactgtgagatccattgattctttggtcattgccaggatttgtccagagaggtacgggatgtcgtctttacagggtgaagcccaagaggaaccatattatgttacaaacttgggggcttttcttttctagctagaggtctaaactcaggagggtaaccaagttttttgttttgttttgtttttggtacacaaagaatcttctgtttctacatccagtaaactttttgttttcttaattttaaattgtcctcaggctgtacctttccttacccccatctctgaccaagaagggtggcagggaaggggggttctaattccaactcagctactaatttaggaggtgaccgataacctctacagttccatctgtcatagtgcctttcacataactggtactcaataataagtgtttgccatgggacaacagaacttgaaatcttctgtgattaatttgtattgatttttggggggcaggaactggaagggggttagttttttttaggatgaaaagttgctgcctcacattccataacagtaacacaaattatggataaatcattaagtataaatcacaactcaagataagtgaaaaaaattttcaaatattgaagagttcttttataaattccatctcctagtgagatgcattacatctcagcccagaatgctgaaggttcttgtgattcctagcacagtgcctcatctttggtgtatgatcagtgaagaataatacaattatgaaatgactactagtaatctctgaggacttctgaggataacaggtgttctgaagtttgccaaacttggagaccaccttcccttcctagaacagatttctaggaaaagtcttcaggtctttttgatcacaatacgataggaattgtagggaggacatgaagaaacaaaagatcagtcagaatgtttcacacactctcaattctctaataaacacagtactaagcagtacctagacattgctctttgcctgaaggtgggattctttagtacctcatacagtaaaagatggtgaacctttcagtgctttttttcagggcaaaaacagcagggtcatcgagtcataactcttgtaatctgggatgcaagttatgtaaccatgtcaggattttcttgagggtttctgtccagaagatggaagacaaggagtgttggttgttttctaaacagtgaactctagaaatttgtagatgaatgaactatacaatacaattctagagaaaactgctaagcaatttttcagcactttatggcagtcaccaaggatcattattggctcacccagaacaggtactgttggtattttttttcttttagtcttaatattaggcttaaattagcacatgaaagtgctagttttaaaagttaaaagcagttgaatatcaacagtttcatgtgattcatcctaatggtttttattatttttttctggttataaaattaatacatgttcattgtagcacacttagaaaaatagaggaaaataaaattacagtctaacaatctattttatgcacttccatctttccatgcatatacatatgcacacgtataaatctgttcaccagaatattttcaaaaaacttactgtggattatagttcatttttagagactatctggctgtttaaattgaacctatcataaacatttctctgtaattagtaatttataaactaaatttttatgatttcaggagatagatgtcacgtaatttatttatcaatacccctattttaggacttttcgtattgttttcagtgttttacaattataaataaatagtgctgcaataaacatcttctacatgaatcctggtccacatctgattatttccttaaaatgagttatcaaaagaggtattttcaggttaaaagatgtgaattctgaaaacatatttctaaatttcttaccataaaggatatactaatttcttttttttaatcttttattgttacttttttatttaactttaattttaagttcatgagtacatgtgcaggtttgttatacaggtaaacttgtgtcatgggggtttgttgtatacattattttgtcatccagggattaagcctaatacttatcagttatttttcctgatcctctccgtcctccaagcctccaccctccgagaggccccagtgtgtgttgttcccctccgtctgttcatgtgttctcatcatttagctaccacttataagtgagaacacacggtatttggttttctgttactctgttagtttgctagggataatggcctccagctccatccatgttcctgcaatggacatgatctcattcttttttatggctgtaaattagttcaaccgttgtggaagagagtgtggtgcttcctcaaagacctaaaaacaactactatttgacccagcagtcccattactggatatataccaaaaggaatataaattgtgatattataaagacatgcatgtgtctgttcattgcagcactattcacaatagcaaagacatagaatcaacctaaatgcccatcagtggtagactggataaagaaaatgggggtacgtacatgatagatatactcatttctgcttttactagcaatgtgtgaaagaacctccctgataaaacatcgccacagttagctgttacttctaagaccaagagaaaaaacaggattgaccaattttgtttttccacctttgataagtttactaaacaaagatatataatttggttttatcgaaggacctgacgaagtttttcatgatatctttgttgtccaatcaaacaatgtgaactgaatgcagatagaatcagggatctcttgtttgcagaacaactatactctggaaaggttttattagtgggttattgtcaactgggagggacaccttgtgtggtgaggcttagtgaccctgtcctgaacaatgttatttacagtgattttgatgaaaacagaacatgagcttaacaggtttccaggtatgccacaaagtgagaaggatggctataagttcttctgtaccatactgtgggctccctgagcaagggagctggagtgctgagagcattccttctggagtcaaactgctacctattagctgtgtggctttgggcagagttacctaacctttctgtgtcttagtttcctcatctataataaaacaggaatcaacagaatatttacctcatgacgtttgttgggaagattaaataagttattaaatgtgaagcactgagagtagtttctggtccttagtaagtgatcaataaagatgagctgctattgttaatctttctctcagatggtagataacacttcttaaatgaatgcctgagtcagtgtcataaatgctttgtatgctggtgggatgggtccatattgcaaatgaaatgtgatgtgtaagttttgcatttatgttttataatattagaaccgtcatgtaaagatagggctgagagttatactgtgtagctccagaaggtagagatacggtttattgataggaattagtgataagatactttctaccaattagctctactcaatagtggagttgccctttcaggtagtggaagaattcaggtacaagcttccagaccattacaagtacataattgaaaagagagggcttctttggctagaggtgagactagatgacctctaaagtcccttccaactctaggctgattctgtgattttgagtggcatatgtaggattatcacatatcatgcaataaggccccacgagtacatctttggaagggttgatgctgctaatccttgcccactctgccctctctgcttcagtttctttcacctgttgtgtgtcagcctgacagtggcccattcctcagcttgattcagttttacagcccagcttagtgtcccaggctgctccctcctcagcagcaatgcctagaggatgagtatatgaaccaagggcacatttttcataagcatacaagaaaatagaagattgttgcctgcaaagtgtatctcagaattgtattttaaaaaaacaagcaacagttttgaccatgccagatgtactcttgtcgctttattcggggccaagggtggactttaccttttttgctcagcagctctgggcactgggtttctctgcttgtctggtttcttgcctaagttcagcatcaatattctaatcccctgggaaggagcagttgagcccacactgttgtatatactatgtgggcttgtatacctttggctgagattatttttctgtcatgaactctgattccttgccttatgctatttaaaggtagcttcaaaataaagttagaaagctgaattgggagcccaaccaattgctttttcttttcagggttctttgctgaataatttctgacacatcaattgtgtaattgttttgtgctgctctccccatttataatatttggagcattggctttttgccacacttgtcaagggtttatgggagttagtgacacgtagtatacaaggttctttgagattctttcatgaaacttggtattatcttgaaagcaaaaggtttaactgttcatttgttagatgactagtgggattttaaacagatataatcacaccatgtcttttttttaaatgtgatgttacgtacatatgaacttttactgctcaaattttaaattatgtgtttttttttcttttttgtgtttataaaatccattattagcaaatacctcaggaaaactttagagtgaaagtcctgaaaaaattttccactccatgttttttaatgttgtggtttgtccttagttttgccatctggtaatgaatggttgaagtgataaactcctggcaccaccgcattttgctgttgatactagtgtgtgtctatagcttgtggtacagaagcactaagtgaggtccatgctgtacagtgagaagccgaaagagttgctgctctgtgtgccaggtgggttaatatgttttagagaaagcatctgtggaattttacagtggatgttcttttgtagccgtattaattttactccttttgagtagtatcattttaccagccagaatctagagcacgcacatgcattatcagagtgatttgaaacagtggtgtacacacgagcactgtggggatggttctgatgctttcaaggcctagagtctcactgcatatattctgagccagagtgttaatcctactgccttaagaagcctttgcttctccttttagtctttagagtttatgaaaccaacagctttgtagtcttcaataggaggattgtacatagagctctaaagattcttggaacatagaaaccataaagaggaacgtgtctgtgtttactcttgtgttgtgttatatgcacagtgtagaactttttaaaattgaaacaacagaggtagatgatattttaaaagattactaaacattagatttttagactcatctcatttaggctgaaaggaaccttctagtccagccccctcattttacagatgaaaaaatataagtccataaggtcccactgagcctgaatcagggttgatgtaaaacctagaggtcttccttcccaagccagatctggttggatctcaccgctcttgtaactgctatagaacaccactgtagcatttagaaagtactgaatcattatgtaagaaaatgactctctcagtaaaacagtgtagttgttgagtccatagtccaagcaggttttatcgtttgtattaagtaacttcagctgttccatagtcttcagaaagtctgagctgactatatttattttatccaccttttacccagttaacagaatgcttactctcttattgccacttaaaagtcatctggaagactcatgctgataatgtaatgcatggtgaaggaagggggtaaagtaggaaaacataattattgcatgcacggtctttttaaaggctcttttctcctctttttcccagtttagttgggtagatctgatttatatagcattttccccccttttcctaaattggataagagctggaagactattcaggaaaagctataagctatagcaaagcgtgtgaaaagacagtagtttgtgcctttctcaaccttgttatagatctgtggatagtttggagtttacaaaactgtacttaaatattttctttaatataggttagggacagatttctatttgctattgatgactgtcaaaacaacttccctagaatgattgtcacagagcatggggcctcattttctgatggagaaactgctttggtttattctcactgtttttacatgattatttcttattttctcaagtgcttatgacatttaaaaaatctgtggttgagaattgtggcagccagtattatgagaaagagaaactaggtgcctgtaaactatttaaatacaaacaaatgatagcaaaacttaaccaggaagaacatgagtttgaaattgttgatgaacgtgatctaggcctaagacaagctgaaactgtatttctcattcattctttcttaaccagaattgctttaccttcaaactcaagcaaatcttttgtttaatccttgagaattgatacttcagaggatttctttatttcagttattgatggacattattcttaggattcagtactgggtcaagatgtgtgttttttcagcaatgtttgactgaatcccaagctttctcaaggcatatttaaaaaccagtactggtaataggcagacttacatacagttttatcagtttatctctgcttttttgagggagagggagtttcagctaagttgggtttgtgctcgtgaaatacaatacaaaaagatttgaccaaataactttctaatcatccttgctgtatgtatattttggtaaaatcctgctcacagggaaaatgtcttgttaatttttggttacactaaagacattctgagcaactaactttggtgtgtagggctaaaattacttgaaatgctgagattgtattgttttgggaagaacttaagtagcattctatttgtgttaaatgttcttgttaaggcaatggaaaagatattagttgaatatattttttcaaattaacttttttgtctttgtgtttttattttaaaaagcttattgtattgtcttgtattaaaaaaacacataatggaaaatttaccatcttaaccatttttaagtgtgcaggtgcacacaacacaggtgcactacgcaattcactgccagttacagtagagtaagaagtagatatttgcctttggggatcttgggaagaagactgctatctatctctaatcctcatggaatccttaagtggtaggtgccaagggctaaggtgaggggggagaggtggagggagttgtttaatgggtacagagttgagctcctttctctataaagcatttaagcttttttgttgccattaattgcttctatgggctaaagaaactgaaagtgtgggcaggtaatcacttggctactaatataaagaggaagtgaaacaaaggactggcttaatggttcagggtggaaagtatacacagttaaaagtaatgttatatggtcttgtaaatagttgtgcatatatccgatgtcaataagaattagtaataccaagttaaaagaaaagcattattttaatatttgtataccttttggaaatgaaagatgggattatttaaagagcaaaaaactaaagatgttctagttggtaagtgactttatttgatgtgatttgttattcggatttacctgtgattagagtggtcatatattcttaatagtttcttcctttttgtgagacaaggtaagagcagcttggcatctaagttttggataatgtgttgctacttgattttttttttccccaagatggagtcttgctctggagtgcagtggcacgatctcggctcactgcaccctccacctcccaggttcaagcgattcttctgcctcagcctcctgagtagctgggactacaggcgcccgccaccacacctggctaatttttgtatttttagtagagacggggtttcaccatgttggccaggctggtcttgaactcctcacctcaagtgatctgcccgccttggtctcccaaagtgatgggattacaggcgtgagctgcttgcttttgagaggcatcctaaacatgttggatggcctacccttattttctgaactaaaatatgttaaaattaatttggttttgagaacttttgaaaaatcatctgactttaatctagctaatatgagtttttttccctatgctctgggcactatcctaagtattttacatacattacttaatcctcatagaaaccctgtgatattatttttccttttttacagaagaggaaagcagctatagagaggttaaattgctcacttaaggtcatagatgtaacgatggaattaggatttgaacccaggtggttggctgtgggttgacatttatcattttaactgctttgtgatgttactccatactgagcatgtaaatgttcttggcactcagcacattgtaggatttaaacaaataacatttatatctgttgagcttcttagaatgactggagatgaagtagtctgctataaaaataagataggaagccattgtactggacactactgatttagctaattgatttcaatccaggaactgattagacatttctttctttctttctttctttttttttttgagatggagtctcactcttatcacccaggctggagtgcagtggcgccatctcggctcactgcaacctctgcctcccgggttcaagcaattctcctgcctcagcttcctgagtatttaggattacaggtgcccaccatcacacccagctaatttttatatttttagtagagacggggtttcaccaccttggccaggctggtctcgagctcctgaccttgtgatccacctgcctcagcctcctaaagtgctgggattacaggcgtgggccaccgcgcccggcctagacattgatttctaaccttgaggtccatgtgtgagttccaagagaaactaaagaatgacctcagacaatcatttagcaaatgatattgttttgttcatgtagtatggcttttgtcctctgcttttatacttgtacaataatagaatttaagaactggtcctgacttggtctaggtagtcaaattcaacctctgcattttaccatttgaggaaacaggtaaaagaaccttcttaaggtcactaaaaaaggaagtgccagagccaggatttaatgcataatagctcacactgacctagttttaccatgagccaggcagtgttctagaggctttatatatgttaactcattaactcctcagaacaagcctatgaaacagatactgctatatacccacgttacagctgagaaaactgaggttatgtaacatacacaaagtcacacaactagtaatgagtagagccaggatgcaaatccagtcattttggctccagtttgtctccaaaccctcctcatggttgtaacatatataattgccatctttttttaagagcaaaaatggttgaatatcagccatttcttatagttcaatctgacatagcttgagctctttctatggcatttcagtaccttaccacaatgcgtatttgtggttattattatatcccacttgatcttggtatatgatccttttaatgtgctgttgaatttggtttgttagtattttattgaggatttttatatctatgttcatcaggagttcggcctgtagttttctttttcttttcatatctttgattagctttggtatcagggtaatgctggccttgtaaaatgaggttggaagggttccttcctcttcacttttttggaagaatttgaaaaagattgctgttctttaaatgtctggtagaattcaccagtgaagccaacgcatgttggtccagtatcctgttgaatagaagtggtgagatcaaaaatacttatcttgtttctggtattagggggaaagcatttagcctttcggcattaagtatgttgtcagctgaagatttttcttgtatgtcctttttcaaattgaggaaatacctttttgttctactttcttgagggttttttaaaaccagtaatgagtgttggattttttcaaatgccttttctatgtctattgaagtgatcatgagattttttttgttttgttctgttttattttttagtttgttaatatggtgatttataatgattgcttttcaggtgttaagtcaaccttgcatttctgggctaaaccccacttggtcatgtctatgaatactttatttttggatttttatttactaaaacgtttagaatttttacatgtatgtttatgaggaatattggtctgaaattttcttttcttgtaatatctttgtcagtcttggtcagactagggtaatgctgccctcacaatgtgttgagaaatattccttcctcttccattttctgggagagtttgtgtagaactggtattatttcatctttaaatgtttggagtaattcaccacagaaactatctgggcctggacttttatttgtttaaaaatttttaactacaaattcaatttgtttgacagacagtcaagttgtctgtttcttcttgagtgagctttagtataatagtttgtgtctttcaagaaatttgtcagatttattggcacgaagtttttaaataacattccctttttatccttttaatatctagaattggtaatggtgtcatctcttattgctgatgttggtaatttgtgtcttttctttttttccagcgatggtagtcaccctgaactctgtcttctggctcttcaagccagaagaaatgggcatcttgcctggtgcctttcctttttaccaattgtagacatccctccatttttggcaagtttttcgttgtgctccagtgccttcaggtagtggctttttacattgtccagaggttatcaacggtaagaggctatttttgcccagtgctgaagatggcatctctgggttttggttttgtaacattctagcaaagccagacatgctttgctgcagtgaaagtgtggaactggataattgagcagcactgtttattcattgttgcctttattggatctcatatggaataaccccactggatattagagtaaattacagagttaggaaaaggtgaaaaagagaaatgtcgggttagctcttttcaaaatattttcagtgggagaaattgttgtcactttaaaaagtgagctttttaaaaaacgaacattttgagtactgaatatgttaagcttctgaatgattttgagtgcttttgcttgtcatggggaagtttttcaagagaagatgaccttttaggcctaaaaacaaagcatttctaattgcttaatgtgtattgtatcaagtaaattatcattaggtcatattaatgctatgatacttaaatattttatttgtagtggaatccattttctgatcattttatactgagcatttatgccaattttagtatatattgtaattcaaattaaaaaatgctagaagtcatcttaggtctctggatctcagcctggtatttactgagtagctgtcaggagccatgcactgttctaggcacaggaggttcagtggtgaatgaggagcttatattcttagaagctcagaaatctaaccctgttagcacactgtagatggtcagactcacatgtacttgccctaatgccaatttgttcatctgaaatgagaagtacagctgttaattagactggtgaggtcgaactgagagattagtgcattttctctttatagacaacccacatgggaagccaaattacaatcacaaggttgcttggtgagaatggaatcaaaacaaagggacttggatagataatccatgattaggacacacctgccacagagactatttgggttttccctaagtagtgctgagcagtaaagcttgccagtgtctgggtcttcagacttatttttatgctgaccattttcctttgttcacaccatctttttcaaaccaagctgcaatacagttcactaaatgacaagcacattccaggcctgcttcctaagattaaacttagatcacctttggaaacatgtagaggcttccaaattctgagcttaggtacacacctgtagagagtctcttgtttgatttcaacagagtgctaccttagccattgtgcaagtgcgtttttaccctcagagggtatcatttttttcccccttacatccatggtgtgggggaagtgtttgagtcccttatagtggtccccatgtactgccaataataccgttttattctgttcaagtggtaatggaagatttgacttctgtttttttatatgatttactgatgccaaacccttattaaatcagtccccacttctaccatgtttccacaggagaggctaatctgtcttaataaggtaaaatgaatttatttgaaaatgtagtaaatgtaataaatagctaaacttaaacctagaaagtcctggaacccaagcatacatgtttgatttttgttgttgttgtttaatgaggggatatactggaattctctttaaaagatccagggaacatgcctttagggatgaatcacatgccttgaggtctaatagagacccaaacattggaattgtgagccattttcacatactagattcttatattgttccttcagttattgtctgtacaccagtggcccacaatccaggttaaagtactactcagtttgctgttaaaaaaagtaaacgaagttaagacccagtgatagccatggttgtcatattttcagtacaaataaagtggtatcactgtccatatatccaccaaaacctatggtcagccagcaaagccttggcaggtacctgtttgcaggttccttggaggcaacaaccataacaacaatagcaatagtgaaagcacatagtgatatatgtgtgtagtgctttgtagttttttcacagagccctgtcacctgaattatctaaatttcacaagtgcaatatataatgtgtaggtatgctggtaaccatttctgctttctagtcaaccataaccttacctacactcttttgtactataaatttttggcctgagaaataggaaaatctattttccccattcagactgccaaaataccttcttttatggacaaatttaattatttcgtgaaattttaggctatgcttctaaggattcttaacaccaagtttaaagtcttttcttgatttattttttttaagctaataaaaataccaggccattctcaaccattttttagtctccacaccattcttaaaatatatcccaattaataacagttttccttacattacttgtgcagatatcagtgttctgattttgcaccgtccagtatggtagccactagccacaggtggctatttaaataaattatttaaagttaaataaaaattcagtttctaagtcacactagccacatttcaagtgctcaatagccattatgtggctagtgactacagtgagtacagatatagaacatttccatcattgcaggaagtactattggaaagcgttgttctagaaatctaattcctgcttagttttgggggggaagatagtcaaacagttctaccatttatcattttatctgcaagatttatatttctttttttttttttttttttttgagatggagtctcactgtgtcacctaagctggcacagtctcagctcactgcagcctccgcctccagggttcaagtgattctcctgcctcagcttcctgagtagctgggattacaggtgcaagccaccatgcccggctaatttttgtatttttagtagaaacgggatttcaccatgttggccactctggtctcgaactcctaacctcgtgattcgcccaccttagcctcccaaagtgttgggattacaggcgtgagccactgtgcctggccaagatttatatttctaaatagatctactgagcctgcctagatgatgtaaaatactattttacatatactttttaaaaatatacataaaacttggaggctgaggcgggccgatcacctgaggtcagaagttcaagaccagcctggccaacatggtgaaacttcgtctctactaaaatacaaaaaatgagccaggtgtggtggcgtgcacctgtagtcccagccactcaggaggctgaggcagaagaatcacttgaatccaggaggcagaggctgcagtgagccaagattgcaccaccacactctagcctgggcaacagaacaaaactctgtctcaaaaaaataaataaaaataaaacattatataaaccttttattttcttagcgcctcctaagttataggtctcacaggtaagcagcaatgggaattgaagtagacactaatgtaataataaaaacgtcccagcttctttacccttcagtggatatttgctgaagtgcaacagaaaagataggtgcaggtacactgttctgcactaaacagaaaacacgtagccatcatataaggagaagcgaccgactgacagtaatcttaagatgattcacataattaagatttcatgatgcaaaaattcaggtcagtcatactctcagataaaatattagttaggggatttagcttgaaaaggcacttggcagttggagaatctctcaaatgtatagctgatattaaaaatgtgttatcacttgttaggttcttaagtgttacaaattaattcagtacgataataaatttgctttttctctttctgcttatatattcacattgtacagaatgaaaggaaaaatccagactaacatccaaagactgtatttttgccatgagtgattcagggaacttgaggttttaaggatgtagtatcctataatatattcagtttaactgggacaaaacatccagagaaacccctttgatccttgcctgtgtaagaatggtctcatgagtggctgaatataatggagaggcatatttattgggggtgaccagtactattccatggtgaaggacagaattggagctttgtaggacagaggtatatctggatacatactaaattctagataggtgaagaaaattgtgtgaatttcgaaaaagtgattgccttttacaaaaaacaagagcaaagtaccacaaatactggcagttgttacattagtgtgattctgtatgattgaatgtatgtttaatccctttttcacttttaaaagtcattactttcttgcaaagttaaacaatgttaaagggcaactgtttttttaaaaaatatatttaattgacaaagattatatatgaaaggtgtacaatgtgatgatttgatatgcatatacattgtgcaatgattaccacaaccaaattaacacgtccatcactatgcatgctgtaccatacatacccagaacttgttcatcttataactgaaagttcatcccctttggccaacgtcttctcatttcttccactccccagaccctgataaccactcttctactctctgcttctttgagttcaatgtttttagattccacatataagttacatcatacagcatttgtttttctgtggctggtttatttcacttagcataatgtcctccaggttcatccatgttgttgcaaatggcaggatttccttttttatggccaaataatatattccattttgtatgtgtgtatacatcccacattttgttcaaccgtttatccctcagcggacacttaggttgtttccatatcttggccattgtgaataatgctgcagtgaacatgggcgtacagaaaaacctcttcaagataactgatttcatttcctttggatgtaattttttggggaacctccatactgttttccataatggctatcccagtttacattgccaccaatagtgtacaagggttctttttcttcacatccttgttaacatttgttgtatatagctagcctaacagatgtgaggtgatatgtcattgtggttgtgatttgcgtgtcgctgatgattagtgatgttgagtaccttttcatatacctattggccgtttctgtgtcttctttggaaaaatatctattcaggtcctttgcccatttatttttattttttatttttattttattttatttttagggacagggtctcattctgtttcctaggctggagtccagtggcacaatcatagctcactgcagcctcaaactcctggactcaagtgatcctcccacttcagcttcccaagtagctaggactgtgggtgtgcatcatcatcatcaggcttggctaatttttttttttttttttttttttttttgagacggcctcacctctggcccaggctggagtatagtggcacagtcagggctcactgcagtctcaacctcccaggctcaggagatcctcccacctcagccaccccagtagctgggactacaggcataggcgtgcaccaccatgcccctctaattttttttaaagatggggttttgccatgttgctcaggctggtcttgaactccagagctcaagtgatccactcaccatagccgccctaatttcttttttaaaagcagggtcttgctgtgttgcccaggctggtcttgaactcctggcctcaagtgatcctcccacattagcctcctgagtggctgggattacaggccattttttaatctggttgtttgtttttgtgctattgagttgtgtgagtttcttatatgtttcagatattaaccccttatcagataatatggtttgcaaatattttctctcattttgtaggttgtctttttgttttgttaattgctttctttttagtttgttgcagtcttacttatttatttttgctgttgttgcctgtgcttttggtgtcatatctaaaaaaattattgccaagaccaatgtcagggagctttttttccctatattttcttctaggagtttatggtttccagtcttacatttaagttttagatccattttgagttaatttttgtatatagtatgagacaaggatttaattttattctttcgtatgtggatatctagttttcccagtaccatttattgaggagacttttctttccctgttgtgagttcttgaccctcttgtcaaagatcggttgaccatgtatgcaagggtttatttctgggttctctattctgttccattggtctttgtatctgtttttatgccagtaccatattgttttgattaccatagttttgtaatacagtttgaaatcagggagtgtgatgcctccagctttgttctttcttaagattactttggctatttggggtcttttgttgtggttccatacaagttttaggattgttttttctatttctgtgaaaaatgccattggaattttgataggaatgacattgaatccatagattgctttggggattatggatactttaacaatattaattctcattgtaaagatgataattcattttatgaggccagcattaacctgatattaaagccagataaggatgctacaagaaaataaaattgtaggccagtatccctgatgaacacagatgcaaaaatccccaataaaatactactagcaaactgaatttaacagggcattacaagaatcatacatcataatcaaatgggatttatccctggtatataagaatgtttcaacatatgcaaactagtaaatgtgatacaccacattaacagaatgaaagataaaaatcatatgataatctcaatagatgcagaaaaagcatttgacaaaattcaatatcctttcatgataaaaacccctcaacaaattagatatggaaggaaagtacctcaacacaataaaggccatgtatgacaagcccacagctaacatcatacacaacagtgaaaagcagaaagcttttcatctaagattgggaacaagataaggatgcccacttttactacttcttttttttttttttaatctttcaagcttttatttaaatgccatgatccaggatggattttagatcttgttgaaagcagccacatccatggactgcacgtagtcctcaaaagcagtgatctgctcctccagcatatctgttccgactttatcatcttcaactacacactgtatttgaagtttcttaattccgtatcccactggaactagtttagatgagccccagactaagccgtctgcttgaatgcttctgacgcgctcctctaatttcgccatatctgtctcatcatcccaaggtttcacatctagtaagatggaagacttggcaacaagtgcaggttttttggctttctttgattcatattgtgcaagacgttcttcccttagcctctttgcttcttcactttcctcctcatcatcagatccaaagaggtcaatgtcatcatcatctttactatctgtagctccacttcctgtagtgtcttccacatcggcaggaccatacttgcccaaagctttcttcactcctggcaggctggccttttccttttcgtaagacttgatgtgattataccaacgtagggcatgacacaagtcggcaggcagtgggctggacacggcttcaaatactgccacatctgcttgtgatggcacatacccctcgatgtagctcttgtccgccaggtaatcgttgagcacctggaggccggcggggcttttcaggtctctgaaacccatggtgtcggctgtatccgagagctggggagcagcagaaagagcccacttttactacttctgttctacatagtagtggaagtcctaggcagagcaattaggcaagagaaaaaagtaaaaggcatgcaaatcagaaaggaagaagttaaactgtttgcagatgacatcatcttatatatagaaaaccctaaccctaaggattccaccaaagaactgttagaactaataagtgaattctgtaaattcggaggatacaaaatcaacatacaaaaatcagttgtttctatgcactaacaataaactatccgaaaaaagatattaagagaaaaatctcattggcaatagcataaaaaagaataaaatacttaggagtaaattaagccaaggaggtagaaggcctatacattataaactataaaacattgatgaaagaaagtgaagacacaaataacatggaaagggcctgtgttcatggatttttttttttaaggcctttccgttaggtcgggtgatatgtgtaatgttcacagagaaagcaagtagtccccttttttctatatgcattttagatcttctttgctgaagtaacagcttgttataagcatgagtatggaaaagagatttttattcgtatttaaagaacatcagtaataaaaacatttccctagctatgacaaagaacagcctttgtttaagggttaggtatgtctaaagaagtgactcttgttaagaactaaggaataaaatataattcatcttatcttgtgtagggaaaactgtcccaacttgaaagccgctgagtgcctaatttacatttaaagctgaagtaatgaagcctttatttttttgccagaaactcccatttctctcccaaatacattctctatcaggaaaaaaagctcattattttgcatggtaatgtgtctttgctgatgcagaaaagcaacataattcaggatgaagggttaatttaaactttcttatgtactcttttgcagataattagaattatttctcagaatctaaaggtgggtttgcagagtacaccaaaaagaatagctttatcctggtgaattgcaaaggaaaggtacagtcctttactcttcaggagaaagaggttcctgaaaactgtggttggatgtagaaattaactctgagaactttagacgtcatagaaactatagttgcaggaggtttaaagtttagagtgtgtctatggaaattcttaagaacaaacagtatttacattcatttaagtcttctcaatgtaatacaaatgaccctttatactcttttatttagtaataagggatccattttctttttcatttactatcccttaagggaaaattggctttgttgcagataagcatgctttgagacatttcccctcctccactatggctaattttctttgacactgttcgttgcctttctgatttttaaatggagaaattgttgacgtccatctccctggagctccccactcacatcctgctccctcctgctgacttagatgtcgtcagtttggcttcattctaaaaatctttatttctgttccaacattagcttttaccttcctttcctattctcaactgcagcttcatctttctctaattatccccaacaggattgaatcatagttttgtgcaatttacatatactgaaactgaatgaaatttttgaagttgccccaaaaatacacagaagtaaaattgagaatatgcaagttcagtttaataagattagatatgagaaattagtgtcatatcctgcaagtgtatatgaatatgtgcactcattttacgtgtatatacagcccccactcatttatttatgtatatgtatatatatatatatatatatatatatataaaacatttaacctaagaagaacttgcaattgttaagctgctcaagaactttcagaggttctaacacagttgcacatttcagcaaaagcaggcaatatgcttactgtcaatcggtggcataatcgtttattgagcagtgctttggatttgtgaacaaatggacttattatacagccttttggagcctaaatggttccaaagacaaaaatcttctctgctactccagcataagggtttcagatcataagtagcagtcaactataaattccggaagccagacctgtgtcatctatcctcattccttgaaacttgggggtatcctagatgaggtaggagatgtcactgaccctgcccaactggtagtcatcagactttggaggaagcacaaacaggttggaacttttgttctgtgagtacgctaaactgttaaagccttgattgtttttgttgttgttgtttgtttggagatggagtcttgccctgtcgtccaggctggagtgcaatggcacgatcttggctcactgcaacctccacctcccggttcaagcgattctcctgcctcagcctcccgagtagctgggattacaggtgtaggccaccacacccagctaatttttgtatttttagtagagatggagtttcatcatgttggccaggatggtcttgaactcctaacctcatgatccacctgcctcggcctcccaaagtgctgggattacaggcgtgagccaccacgcccggcctattgtattgttttttaaaatttatccctggaattggtttgtgtttttattttttaggaatgattatatacattgaccttgtgccacatgcttcagattttataagaagtaagctgggatgttccaagttccgtgttgcatagagttcttatccatgaaaaaatgtccaaaaagatgatttagcaaatttaggattatttcatcctaatttggtattctctatagtgggagttttagagtgtttcttgtgataatcattatagttaagatttattgaatgtttactcaaaaaagttgaatttttctactggttttgggactacttgggtgagatatgtgaaatagattcaaatattgaaatattgaggtactcttataacagaaaatatcaaagctactgccatagtttattagaaatcaggagaaagacttttttttattgttggcctgaatgagctgaagttcagagtaagactgtggtcattattcattacctcttttttttcaaacactaaaactcttgggtttctgtggacaaggctgctttttaatggcatgttctccaaacagctgttaagcacccccctccccaataccacagaccacatctgttcccactgttgattagctagagggtggagaaaagagaggctgtagcatgtgtaattaccagtaattaattcttgttgagcctcctcatttccttctattctaactacacctactcttcttcctgcctctgttgtaaattctgtttcatgttagctacttgtggaaaataatcttgatggttatacagctgttttcctaaaattttatattcacctaacagtgaggcttttatttttcttctggtggcagaatcatttaataaggcatgccaaataagaaaataccaaagtaaccaagcatatctcttggggctagctttcctgcttatgttcttttactgttgatactatttccaactgtcaagaaattatttttcagatatatcctctgttaaaggaactattgcaaggcatgatttagtgtgaggaaaacaaacgtaagacacggtcctggtcctcagtgttaatgtgcagtgtatggaaatataactatgtaaattaacatatattaataatatagtaatttccaaaattgtcaagatcataaggtggaggtagtcttctactatttttcattctctttgggataaagttgggctgacggaaattcaactttgagcgttattaatatgtcatggtcaaagagagatatcaaaggcttgctctttaaagaaaattcacagcatatcttcttatttacaagtcttaaaagcctagattttctgtaatcccagcactttgggaggccgaggtgggtggatcacctgagatcaggagttcaagaccagcctggccaatatggtgaaaccccatctctacgaaaaatacaaaaattagccgggtgtggtggcaggtgcctataatcccagctacttgggaggctgaggcaggagaatggcttgaacccaggaggtggaggttgcattgagccaagatcgcgccattgcactccagcctgaatgagaagagatagactccctctcaaaaaaaaaaaaaaaaaaaaaaaaaaaaaggcctagattttcaaaaggtgttgctttgtgtgagtctactttcaggaggatgaggtttcaagaagacatttcaaaactgctttttttgtttgtttgttttaaaatttatttggtctatcagtcaagatcctggcaggaaagagatgacattggtattaataggatttgataaagagattgttcacaaaaatgtgggcaattatagtgaaatcacaggagaattgtgtgaactctggtgctagtcataggagggttgttatatgaagagagtctcttttttttgttttgtttttttgagacagaatctcgctctgttgcccaggctagagtgcagtggcaccatctctgctcactgcaacctctgcctcccaggttcaagcaaatctcctgcctcagcctcccaagtagctggaattacaggtgcctaccaccatgcccggctaatttttgtatttttagtagagatggggtttcaccatgttggccaggctggtgttgaactcctgacctcaggtgatccgcccgcgccagtctcccaaattgctgggattacaggtgtgagccaccgtgcccgtccgaagagagcctcttgattgtgggtggatggaccccgccatcccctcggaagagacctgttgcccttcctaatgcccttttgtttctttttctttttcttttgagactgagtctctctctctctctattgcccaggcggctggagtgcagtggcatgatcttggctcactgcaacctccacctcccgggttcaaatgattctcctgccccagcctcccgagtagctgggactataggtgtgtgccaccacacctggctaatttttgtatttttttagtagagatggtgtttcaccatgttggccaggttggtctcaaattcctgacctcaagtgattcgcccaccttggcgtcccaaagtgctgggattacaggcgtgaaccatcacacccggccttccctgtttaattcttcttagcatctccactaaacacaaaccaagaaaggtgatttttctctttgttagaacttcttaggaaaacttcactattctcttattccatctgttttggggttgaggagagctgttatataagaagttattgttagggtttcttgtattcctgttgtaatattctcaagctgacatatttgtgatagatcaacaaagcagtaggtattttgtaccgctacctaagcaataaaagcaagtatgtaatgctgtagtaccagagttgtggtttttcccctgcacaatatattaactaagcagaaaatttaaaagaacaaagacaataaaagtaatgtttgttagtggtagtttgagatatttcaggagagatgagatgtgaagaaaagcaatggccatatttagaaagctgcctcaaacccaagagtatctattgaagtaaacttgatgacagacttttttcctcttcatgaatcattgtattcctataaaagcgaaaattcctcttcatctaaacaaatggcttcaacatctgttttcttagtttctcaaaagggtgtcttcggcttgcatttttttttttaaaagtgtttatctgtttaaaatgaaatatcgtcaaaagcagtttgtacatcaaaatccaagttggtcttcagcttgtaagaattagttgagaattatctggtggtgttgatagtggtataggggaaaaaagaaattacattttgtattctgcataggtaagttcttcttcctaaccatattctttaaatttttttgacttacatttaattttacatgctcttagctttggaggaccgattgactaggaaacttgatcgttgagagcgcattccaacgttttaatgctctgggttctgaaagtattttaaaaattagcagctggagaattattctgttagtcccattgactaggaactgatctgtagttggtttgattcttctcttgctcccataatcagtttccttctaccatgtcactaagagaaacacacttataactggttcgtaaatgacttatgtgcttttctgaagcactttttcaattcccagtctcctgtgaatttgtataccctcaatggtgttggttttatcttttttaatctttaatctcttcttgggtgacaggccaccatgcccttgagcccatcctgccatttaaaaataaagaatgagaagcagctgaaatgctggctcttttgcagctgacaggaatcagatctattgcttagattctttatctgggtacagacatgccagtggtgtgtgacttgttctagccatgccatttgcagtcacaaggtttaagaggatgggagtagaggaagttgtctccaagagaaagaaagattttttttttttttttttggatgtaaaggtcaaggagaaaggctgtagatcagcacatgggttcccactgcaggtcacaggactcctggcttcttaccacccagtggaatttctgggccatgatagaggtgtttgtctttccgaaaaggttgcataggctcctcccacccccatccaccccacagctgtctgttgtgtctgaacagtggcttgctctgaggttaaaggtccatgaaaactgtgagacatttgatgttataaaatctaattagtgacaaaagcaattaatataatcacttatgacttagtttctctggaagggtatacttatctttattgaataagtataaatggtaactgctagcaaatggcaccaaacttaacataaaatagaactacccccacctctctcctcctctccagtgcagaagagaggcagtgaaaagggtggttatggttatgtaggtgtagagggctctaggaggctcttgtgacttgattggtgttcagtctccctgttgagcccatcaacatggcctcaaggaggggagctattgcaaaggttttgcctgctgtttgttaagccacagcttgtagttttggttgcacatgacaaagcaaggtgctctccttttttgaccttgttcagaggcttaatacaattatttgtattaagcactagccacctgttaggatcattctcattaaaggtcactgtgtggtgcctgactgtctgactatggcagcctgcatcagatttgctagtggcccctggtttgtgtgacacctgccaatagtaacagaaagaatggagatctgatagctcaaagggaacagaaggtactagaggaggaatgaggaatcaggagaaccatggagcacctgccactctagcaccattaccatggtttttggtgctaacttgcctagtctcccttttctctggctaccccttcagtgagctgtgccaggcatttcgaagagttctgttattgtctgcatgctgatattgctttggtttattgatattaatatattgcatccctgttaagcgttgaatttcttgtacctgaaattccttacatcccctctgctgaatgtcttagcttctgtctgcttctctgtgatctccattgaggtgttccacaggcatatcctattcagttccaaaactgcccttgcagttctggttgccagcctgtttcccttccctgattcccggtctcagtgaatgatgacactgtttacccagttgttaagccaggaacatgggtatcattcttgactcctatctcttcctaatgcctcaaatccagcccagtgccaagtcttgtagattgcacttgctaaatgtctgtgattctctgtctccagtgtcactgcaattatgctgttcaggcctcattacatctccctggacactgcccccctcaagtattctccagatgttttatagccagagagaactctttaaactgccaatctgcttatgccactccccagtttaaagtccttaatgtgacttacaaggcccttcacatttgggcctctctcccaccctctctccatttcccctgaacattctagcctcaaccatacattttattttctttgcctttgtaaaaaaaaaaaatttgtttttttaaaacttaattttttttttactcaccattcagcatttccctgtgttctttgcatcttcacaaacactgttcttccatcctccttttcctgttattccctatactcaccttccccttatacattatctgtttttatggacttttctctaactcctgccccaggagcccctgttatgtacatgtgtgtgtatgtagtatgtgtgtattttccaattgcctatttggttctctgctctactgggggttatgccctataagagggaagggatcatgtctgaatcattcacagttgtgttccctatgacctacgtctagcacatgagaagagtttagtaaatactgttggtgtttgaatgaatgagttccttcttgaggttctaaatgacaagagaatatagtgcttcctataattcatatcaaattcttgagccttggccaaattagagagtggaaatgcacaggctgggtgcagtgacttacacctgtaatcccagcactttggggggctgaggtgggaggattgcttgagtccaggagtttgagaccagggtaggcaacatagtgagaccctgtctttaaaaaaaaaaaaaaaattagccaggcttggtggggtgcgcctatagtcccagctacttgggagggtgatgtgggaggattgctttagcccaggaggtcaaggctgcagtgacccaagattgccccagtgcactccattctgggtgacacagcgagaccctgtttccaaaaaaaagcacaaagttcaaaagtgaaggagattgctttcttttaaagcagtgagtagccaaacctcatatatcctttatattgcttcttcatattctgtatctccatcctaaattacttttctcaacttgatctttgtttgatttaaaatttctctggattcttcccagcaaaagtatagagtataatgggacaggagaaaatgtgattgataaatgggaatatgtcatttgattgattcttaaatatatagttgacccttaagcaacatgagtttgaactgtgtgagtccacctatacataaatgttcttccacctctgccaccccagagtcagcaagaccagcccctcctcctcctcagccctactcaacatgaagatgatgaggatgaagacccttatgatgatctacttccacttaatgaatagtaaagatattttatcttccttataattttcttagtaacatttttttctatagtttattttaagaaaccatttttttctagtttattgcccaccttcatattgtaagaagaacaatttttctctagtttgttgtttatatgtatataatacatataaacatacgaaataatgtgttaaccgtttatattattggcaaggtttctggtcaacggtagactattagtagttaagttctaagggagtcaaaagttatacatggatttttgaatgcaaggggattggtgcccctaacctccgcatcgttcaagggtcaactgtatttattctagagtcatgcctgaacatgtgtctacaacacatgtttctctggacagttgaacacgtttacatttccctaaaactaggcagtctttctcagaagattttttttaagtgggacccctctgtattttaatcatagctagctcatagaatctgtttgttgaacttacagtagaatggaagtgggcaagggatgccactttgtaaaaaaataaagagttgctttaagaggccgtctagaaagtgtggtcatgatagaacataatttagtatttagctctggtactgagcaagggaattaccctctgaggtattgggcctaaaacattctccctcgtctcacttcatttgaagaagagagtaattatggacactgcaatggctattttgtcacacactgatcctaagaaggagctttctagagatcagaatgcttctgtcaaaatggtgacagcaccaccttggtcactgtccaacttcgggttctccagactaccagctgtgtgctcttccaggattgagcttcagaccaggtgtttagtaatgacaagggacagcttgttaaatctgccatttgtgggagctgggagctcaaagttttctggtcagattttcccatgaccttagttataaagaaaacgttacagattctagaaaatgccaatgtcctttttagcgtattacactgattgcagtgcttcagaattgcccaacttcattatctgagcatagccagcctgacgccttcttctcaaatagacaattatgatcaattaagcacttttaggccttatagaatacttaattttattagccaattatttgtgctttgaaagagttaatggtagctacccaagccattattagaaattagaatgtcccaaaatagaaaggctatttcctttgtgtgtggcactgcagtggaaaatgccaagcatagtttttactgagttaaagggtgagggaaggcggggtgggggagaaagttacatgtaaatcatttagccattaacctaatgggtgggtttataaatcctattactataagcccttttcatttccactgaggcctggtgcatgcttgatcccactaatgtaaaattcattccgtctaagtgattactgaagtaagacactttgagtcaattttaatcaggttgtgtgaaacttgcttgagtgctgatattcactaaagcatggacatagtttggccgtgtcttaattagcccccctggatgagttatatgaggagtcagtcaggaagccaaatctctgagccttttcacatatacatgtttctgtgagcaaaataaactgtaggtaggggctgaaaacacccacctcaaaagcaaggggcaaggacctttgggtgagtgtgtttctagtcttaatgaaaattgtgaatgttaagaaatctgaaagttctattcttacggtgaattggagcatcctcaatggtacttatatttaaacaaatcagaatttcaagtttgattaaatatgtggatcttctttctagaaaaatgcacgtaagcacacattcaaatctttgctgacagtttcaggggattttcagatttcttgaccttaggttaatacctactgctccagttttaattttagtatcttaggtttttgttttttttttaactggggatgtaatatttaggattgtataggctcatattgagctcttgtgtcagtgagtagatttggttcaagtgtgctttaaggccagctctacaagctgtccactgtcctgtgtcagatataacccgaagaatggcagcaatacttgtaaattcaagtgaaacatataggacatgaacttctaaactggaggttggagtggaagaggaatggagaataagaatgttgtgaaaggaaggtttctttaaaggtgaaaactgagttcttaaaagtcagcatgtgaagtgggtttttaagaatccacaggatgaataaatagtcatgctggggacaagaaattataagacacgttataagacagggaagaaattcacttttcctttcacacattcaaaggcatagtttgtagtattttaagttttgggatcaaaataatagccctgtcaaactgtagggcaataatggagagatactcataaatcgtattaaatttgtctttttgggaggagaagcctttcagaaattgttgtttattcagtgttttatattcttcatacatgagctaccagaaggtctaggttgtaaattaaggatttaaaacaaaatcagtttatctggaaactatagttgtatgggagaggtacacttatagtcaagtttataattaatgggcctttgtcattggaatagaaattcttttctcttgagtgaatatttgtttatataacatgcattgtgtttgaaggtgggatcaaaactgattcactcttcatttcttgcatggaaaaagccagcatttaaatgtgtactgtgtgtgggcttaattgctgctttttgtaaccaactttagggtcctgttgttgtggagatgcacttactgatcgataatggtttgctcttcttaagctggaccactaggagttttcctccttttactagagcctaaaaaataaatatttattgaattattactttgtgccaggcatttcgttaggtttaatgcccatgatatgatctctgcctataatttgcttatggtctcttaatcttaccttttgtaagagagtggtgtgttgtggtatgcacagagtactttgggggatacataggactaggatattcattaatatcattcggttggggagtctcgagaaggcttttctgacagtattaagttccttgtgaaataagtagatgttaggtaataataacccctaacatttattgagctcttatgtcccagagaccatacaaaacaaagtacatacatcgttaaatttaatgctcacagtagccctattaggaagcttcagttgctatctccattttacagttgaggaattggaaggttagagaggttatattgtttgcctgaggtcatcgcacagcttattagcagtgctattaggctttgaacccaggtagcctatattagggttttccagagaaacagagccactaggagaggtgggtgggtgtgtgtgtgtgtgtgtgtgtgtgtgtgtgtgtgtgtgtgtgtgtgacatttattgtggaggctgtcaagtctgaaatctgtagggcaggccggcagcccagggaatagttgatgtttcagctacagttcgaaagcagtctgcagcagaattcgttctcccttgagagacctcagtcttttccttttagggccatcaactgatttgatggggcccgctcacactgtggtggatatactgctgtactcaaagtcaactgatttaaatgttaatctcattttaaaaaaatacctttacagtgacatctagactggtgtttgaccaaatatctgggtaccgtgacttagccaagttgacacataaaattaaccatcacacagcctaacttctcaactcacatttttaaccacttggggaaagagcatgtaaaaacacagaagcaagaagaaaagcatagcctgtttaatgaacctaaaatattttgagagggctggtttgaaggtgcatgtaggaagtgttagaagatgagataggcctcaactagatgagtctcaaggacaggctcaggggtttgaattttatttcaagaagtacattttattatagaaagaacactggcaaagtgtgaagattggcttgggaggtagtgatgctagagacaagtaggccaagagagtgatgggtgtctgaaggaaggacatgggaatgcagaaaaggtgccacattggaaagatgcagtatagttagtgtagcatatgtgggctcattggattagaaaggaaaccatttggggccaggcgtggtggctcatgcctgtaatcccagcactttgggaagccgaggaaggtggctcacctgaggtcgggagttccaggccaacctggccaacatggtgaaaccccgtctctattaaaaatacaaaaattagctgggcgtggtggcgcctgcctgtaataccagctactcgggaggctgaggcaggagaattgcttgaacctggaaggtagagtttgcagtgagccgagatcgtgccactgcactcccagcctgggcgacagagcaagactccatctcaaaaaaaaataacaataataaaataaaagatagaaaggaaaccagtccttggttctggttgaaggtttctggaggggccagttatcatgtttggagctggttaagggtttggaggagatgggtgggatttagaatgaatgcttatgggaccaacagttgaatgtgtgcctggatagagaaaacgctgtcatcagtgtgtatcactgattctcaaccggtgcagttttgctcttcctaggaagtgcttgacaatatctggacacaattttggttgtcacagctggagagaaggagagcacacggcatatgtgtgtactcatactactgatgaaatctagtgggtaggggctagggatgctgctaaacatcctgcaatagacacaggatagctccttataataaataattattcagcctaaaatgttaatagtactgaagttgagaaatcttgatatatatgtagatgtgtatatatacccccgaagtgtggaaaagagatctcaacaggtgttggatgttattatgtattttaaatgtacccactcacattaagtgcataaagatgtatccagacaacttgtgagaacttacgtgtttctagttattttacaaccacatagccctcaaaagcaacctagaatatggaaatatatcctcacaacgctaattatccttgttaggtacactagtacttccttttcctaatactgaagaagtaaatgtgattgaaatacaaaccaaccaaatataatgaagagacatttctacatgtcaaagttggattctagatttttagacctgtgaggaatctcaacctcttcattttataaatgaggatattgagacctagaaaaggaaaccaacttggtcccaaatcacttagctggtaattggcagattaaacaagtgctctgatttcagaccctagacttaaaaaaaaaaaaaaaaaaaaaaaaaaaaaaagcacgaatatttgtataacattttatctttgcaaagcactttttaagcctgtggttctttttattcttacctagctcagggaacaaggtggtaatatcaccccaatattagagaaaataaaactaaggtttaaaggcagtaagtagcccagtatcacagaagtgttaagtagtgaagacagaaagtaccatgcttattaaatccatagcccatatttcttgaacatttttagaggaagacacaaatctaagaataacagagaataggaaaaagacaatctaatagaataaggaggaaataaatgttcatcaagtgagagaactgagtagcactgagtcctgcttggcagttgctgaaatttggaatgtggaatgcttaggtaatggttggattatcaaatatcataatatttatattaatatttcacctgcctttctctttcctagccttcaaaaccatttatattttactacccctgttatgctaatgtattgtttaatttccagtttatttctaattttatatcatcggtaatggaagaatcctaaagccattgagatttcagttgtcattctctttttgcattatttgtttagaatttcaccttactcaacattttcttaacttgtaggattttctttgtgtttaatatctgcatcatacaccaaagtgggtttcttgttaataagtaatactatagtagacatgttttcggaataggaccttgaaactttttttttaagctgtggaaagctggtgttttctctctattgtttagtattaataaatactcttttagtctgtaatagcatctaaaaacatttcataacctttggatgcattgtgatacaacagtattctattttaacaagatacaaagactcaggtgttatcctgaacttattaggagaacctacaaatacacatcttagtagtagttggtcttaggttgttgctgttgttaaccttggcacacacaaaaaacatctttctgcttagtaaaccatatcgtgggtatattcatgaacacattattttctttagaaaacaatttttgatacacatctaaatttcctttctagttcccactacccttttccagctttcagaagctcagactggggttaaaattccttttcgtattattttaattattgctctccccacctccacccctttcctgtttccccctcctcttttcccctaacggcactgttctgcaaagcctgcaatgattgatatgatggcagtgctgtcattctttttaaccaaaaaaaagtcatttttgttctagttattttaatagagtcccattaaagatgtattgctgactgaaatatcggcgtgaagggctctcactgagctgagcccaggaattaagaagtcaggaaatcggctgctgcattgcaagagagccttgtgtgacaccgagtctcctgattggggagatcattactgctattatgactcgacttgcgtaggaattttaaattccatctgaatgtcagtaataaccctcttagcaaattatcctgaataaaatcacgaaggcattttatataataggtgttgaattactggatagatttgctaattaaatactctttgttctgctgcagttgacattacagggtaagatcttgaacaattattctcaacagctgtactttgttaagggaaaaattaaccacaaagtttatttttttatacttgaagttggcagatttttgaaatgtgcttgaaaaaattccatcatccaattggtaatgagtagataaatatgcaggtgttgctgtgaaatcagataactgcagactgccttattaatgaatttagcaagcctttatagccctgttttctagccgttagcacttacaaaatgattttctgtcagaatgggcagctttaatattacacttgtcacttcaaagtgaacttatgaatggtcatcttgtaatcattgtaccttgtgtctagtagacctttctgggtacttgtggctatttttaaaatgtgtttcttcaatggggaaaatacctgtaatgtataagtgtttgattgttgacttctagaacatttatgtggtatgaggttttttttttttttttttttttttttttttttttttttttttttttttttttttttgagaaggtagtgagacataatgaaaagaaagtgaaacataaagtccagcttctggatcaagcttttgggcaaaatctcagagcctaattttcctcatttgtcagttgggatttataatactgtgtaccccttaggattattcacttagcattctataaatatttattaacagctcccatgtaccaggccctctggtagatagtaagaatttggtagctccctgagtagataacatctgagccctccccagtgagcagtttgaattgagggctggacttgagggcagctttggagtgtttctgctcattagcacttggataagcattggactagagaggtcactgtgatacccaccatctagaactgcttagtgaagaaacatgagaggttaggggtcagactggttgtgggttgtcttgtatagaatgggctgaagagttgacaaactgtggtgaggaccttgaacctgagatggaacattatcatcagctgctagtgaggcccactgaaaagatggtgaggtccacagaaatcggtacaacctctatagagagctattgggttatatttattttaaaaatttgaaacataacaacctttgacccagcacacccacttgtagtaatttatcttgttactggcagatttgtaaattacgtatgtatagggattgtttgttgaagtatggttgtaacagtaaagagtagaaacaacctatatgttcattaatagaacactagttaaatagattatgttctatttatacagtggggtactatgtagtcattagaaaagaataaggcagctctttatgtgtgaatttgaaataacctctaggataagtgctaggtgaaaaaagcagttgcggcatactctatagtttaccatttctgcaaaaaaagacatccaccaaaagatttctgccaccaaagagaaaattgttttggtagcagtcctcaggttatgcatggcaatggttgtgagttggtggcaggatggagtaggggtggatgatggatctgaaaggtgaaggttgccagttcacattgaaggtacactcagggatgacatagtagatttggttcatgttgtgaaacaagagtagaagaaattggttattgaatatgtggagttgtagtaaaaggttgacaaactgctcctcaggtattttattgaggtaacagttacgttatggtgttgtccattgtgatgaagaaagctaagcctagctaactgtaagaggcagagggtaaagaggactcttgataagtaattctgtcctcactgtgattaatttgccttgggttggtctcattattgccctttccctaaaggaattgtcaaatattctcccacaatgcatttccctataatttaaatgttaaaaaatgaagatgaagttggggagagtgactgttttttatgttagctgaattttagtgtctagtggaaaagtaattgggattactacaggacctatcagtcacctggcaaacagttttttgagttcctattacagtgaagtctgcacttaggcacaaacatgtggtctgacctccaggagcttgtagtctagtttggggtgggtaggtgggagctaataacgtaaagcatcattcaagtactagtaaaataattcaaacacagatgagaggagagagacaggtatgggctgggccagtcagctcatgcaggaaggatttgagccgagggttgtaaaattcaatgataggaaaaggactggggaaggaattccgggtaggagacacactgcatgagtgaaggcatgaaaagatgagtctgtacacagttaactgttggaagactgggagatttattctgtccagcaagaggatctatgtaaaagaataacaggccatacaagtggaacagtggtttaggtgcagttgcagaatttgttcttgaccttgtaggcatcggagaggcattgaaaacattcaggagattggtaatgatattcagggtgagttgatgagacctaaagccagtagagacgcgagttggttcatcctcagtgacaacctcattgctatggagtcaggcgctttccaccttgcagccggccctgctcagcatgttagcttgcaccctaggcatggcccttcatggccaccgtgatggttgccactgctccaagcagccctcagtctaaaaaggtagtcccccaccgcctgccccctcaaatcaggaaggaaaacctttcagagaagcatcctacaggaattctccttacgtttaattggccaggattctgttcacatgctcacgcctaaactgatcatagtttccagaatggaattgccatgattatcttaggccaatggtccttaagccagcttgcaatgtaagaaaatgtaagaaaactgttggggccagatattgtttgtttttttttttttaagatccccaggtgattccactgtacagtcagtattaaaaccactggcttagcctcatcagaattcaccaccattcaccaccccccaggtaggagaaagggcttccttgtctaagaacataatattaatacaacgaacatctgaacaaaactgggagatagtaataaaggggagagggcaataaaaaatggaaagtaatgggtagatataaaagatactctaaagacaggatttacaaagctctgtaatagggaagacgagaaagaaatgacaccatgaagcttgagcttagttgacaaggaggactattgaagtaggagaaagaaatataaatgaagtaaatctttatttggtctattggaaaggtgacctcagctttaggctgatgctttgaaagatgggtgatagcagagaggcaatagcatggagtgactaagaccccatactcgagtcagaatgcttgggttcatatccttgttttgtcattctaggacactaatttctctttgtcttttggcatctaacaagagaggatattaatagtagctaccccttggagatctaggggaatgaaatgagaaaatgcacaaggtgttccttgcacagcatctagcacatgtattttaaacgccccccccgacacacacactttctctctgagtcctaattatgtcatattactattttttaagaggctgtttgttaaatatgtgttacttctgatctggctcaaaataatttatatcagtttttatttctatccacgttgtaacctaaatatctctgatctgtagctatatgggcctggggacagacttatcaacagatatccacgttcgtcttaattcactgaatgtttcttgagccccacctttttactgggtactggggtagctccaggcaatatagtgaaaatccatctactctctttcttcaatgaatttagtctagagaagaattttaaatgtagtgtgcttttttttgctttttaagatcctgaataccatgaataagaattgccagatttgaaatgctttgttaagctttttttaggcatgcagttctatttaagtattagtaatgagaatagtttgcttttttgccatgttatagagatattttattgtgtgtgtgttaaacatatatatgtatatatatgcatgcatatctctggctcagaatcagcatagaggcaaacttagattatattgatgttactgttattttaagggctgttgttagaaaaccttcaagagctttagaaatacatggaaatggcaaatcattgaaagttacctatctctatgtgcttctatttatgtctttataattgtgtaacttattaatcttgacttttgtttcatttagattttgatgcatacgaaagagatggtacaaaaggtaatgttgagcattttcattgtgtaaaacttaaatatcataactggtaacgtttttgtattcaaggaaaattgtaacccaaacagactggaaattgcttcttaggttgcctagtttaacatttataatccttcctaatggattacagcttttttcttttaccagtgctgatatgatctagcccctgcttgaagcctatatgtgagtgtttcaaacaaattagtaacagtgctaattagagtttatttccaggcctttatactgtatgtgctctagtgttgtttgttatgattgattttttttggcactcttcgtgttctactaaatactgtttgcaactgtattaagaatttaatatggatttgtgcccctgaatttatagaatccattatgtttccgcttcttaaattgccatgaccactaagcatgtggtacagtggataaatatagaccccatttcctagtcttttattctcttttttctcattatttaatttggtattttgtttcagttgaaactagacacaattctccttccactccactctctattttaagaaaatttgagagattttcttgatgtcaggttgcttgcctttctggtttataggggcttaatctttaattgtataccctgacaatataaataataattaacataaacttttgaaaagtctgtggagcctgtaatttctgtagtatggaaaatctttagtttcattgtatgtaatggtcactgtgtttttgttaatttttataatttttgcttttcatcagatgaatcttgaagttatttatggagatacagattcaattatgataaacaccaatagcaccaatctggaagaagtatttaagttgggaaacaaggtgagataattttatgaaattatctgctttacctatttttgtgaattctgtttctaacatggaacactataaattcatgtgtatatgaatgtgtgtgcttctgaaaataataaacttggtgtctctcaattcttctatttttctgtctttctttattatttttttctgagacagggtctcactctgtcacccaggcttgagtgcagtggtgcgatcagggcttgctgaagcgttgacctcctgggctgaagtgatcctcccgcctcagcctcccgagtagctgggaccacaggcactcgccaccatgcccagctaattaaaaaacaattttttttgtagagattttttttgcccaggctggttttgaactcctgggttcaagcgatcctcccaccttagcctcccaaagttctgggattacaggcatgagccaccatgcccaatcctcttttttttttttttcgtcttgttttgttttgtttgtttgttttgacacatagtctcgctgtgtggccaggctggagtgcagtggcgtgatctcggctcactgcaacctccgactccctgcaacctctgactccctgcttcaagcaattctactgcctcatcctcctgagtagctgggattacaggcatgcaccatcacgcccccctaatttttgtatttttggtagagacggggtttcaccatgttggccaggatggtcttgatcttctgaccttgtgatccacctgccttggactcccaagtgctgggattacaggcatgagccaccgcgcctggccccctcttgtttttaattcctattccagctgtttgtttcgagggtgaaattcaaaggttttttttttttttttctttaaatggtagatacatttttcctttgaaaacagtctaagtgttatatgtttaagatgtgttcacgttagtacttactacattgtgattcatatgtctggtaggattcaggtgcattttatacataaatacctacatacatacatatacactcacaactgtgatttttacaggagtacttaaaatatatttgaaaagtcaaggggacatttaaaaataatcatttgtagcctcttaatagcaatttgcaatcgcaattcacagtgttttagaaacacttgctatgttaagatgttgtccccatgaactaaaactaagatgtcatcttacaaactaacaacttcctatctttccctcctggaatatgtggaatttgaatggtagtcttcacttgacagcaagcctggcacattgtgctcatactgggccttgaaaagttgagtattttccctggaggtgatgttctgtgccttgaccctgtcagaaagagcagaggactctttatttgttcagcatgtagttgtttgcttatagtcaaggtgttaagggaggtcttaaacattattttaatagtcaaagtttgacttctttatttctggtcacatatttagttgttggactgtctattcactaactaactgaatagtttgaaggcaagtactgtatgtatgcattaagtctttacattcaacaaggactgtttcataattttcatatattacctggggctgatccagccagtcctgtcctttggttgcatgggatgatctattattgtctctctctctctcttttttttaatctatttttgtccctgcagttttcaatgtctttgctttatacccaatgtaatatcatgttacatacaagccaagtaaaattccaatgttgtatgacttcaaattctgtttagattaactcttgggaatttgtaacatgttcatcttctccctattagatgtttgagaagctaatactaatatttgaaattttcacaggtaaaaagtgaagtgaataagttgtacaaactgcttgaaatagacattgatggggttttcaagtctctgctactgctgaaaaaaaagaagtacgctgctctggttgttgagccaacgtcggatgggaattatgtcaccaaacaggagctcaaaggattagatatagttagaagagattggtgtgatcttgctaaagacactggaaagtgagttcagctttcagttttgcttttcttgtttgtcttttaaaaattcaggtgtgaatgatgtagagaatgcttatgaatctgtcaagcccaagaacacttctttgttatttttattattcttattaataagaattattaatcattcttatttggaatggaattttataggtagattaaaacttagaaaaagccaaatttgctcagtgagaaatgcctgctctaagatacgtctcatgagtttttaactcatagtaagggtaaaccttcacacttcagatccttatagagttggtttcgttgatgttggtttgttttgctctattgttgctattagaaagtgccttgttttgtgctcctgaatcttcctagagcctcttgagggacataattgttaagattttcccattttatggcttaaaatgttctgggactcaaaatgggccatggagtgagactttgttcccacccgtatgatttgtatataaaagattcttactaataccaagttaagggctccttctcaaatcctgtgtgtacctcagaattagtaaatatcatgattgacctcctagctttgcacctgagactgaagaatgtgataataaggcctgcttctttaagggtcatattaatgtataaagcacccatttcaaaatgaatttttaggccgggtgcagtggctcacgcccataatcccagcactttgggaggccgaggcgggaagatcacttgaggtcaggagttggagaccaacctgcccaacttggggaaaccccgtctctactaaaaatacaagtattagccaggcgtggtggcacatgcctgtaatcccagctactggggaggctgaggcaggagaatcgcttgaaccttgaaggtggaggttgcagtgagccgagattgcaccattgcactccagcctgggcaaagaagtgagacgccgtcaaaaaaaaaaaaaaaaaaaaaagaatttttaggtgcttcatgtaccgtcttaatttgtgaccttgaccaattctgaaagtagaagaattttttatttaaagctaaagttcacatcaattttaatattctgaatgttggcatttataaacttgttttctagtcttcctcttgctatcaagttgggagattgaacaattattgcttctgcaaaactattcttgattaggcaaagttgaccagctgagtataggtcactgtgagccttttaccaaatgtaaaaatgtttgaaatgcttcattgcccccaagtgtacccaaagaggaaagtactttgtatggactgtggattagagtgttctcttcagctttgtgttttctaagaaaagacgcatcataatagaagtaaatttctcttgagttagaaatgtattagtaattaaagctatacaaatgtttttgtcggggttctttttctggcaaattataatgcagctgtcaaactctcgctctgcattttctcagaaatggataaaatattggctttcttactcctttcctttttctttttcctttgggtctggttgaataacatgaagtttttaaggaatagcgtaagggagaacactgagcaacaaaatgaaggtgaagaaagaaaagtttgaaatctttgttttttaaaaaaatttatgtaaaggacttcatatttctactcatctagcgcatggttgttgtctcaggtggagatgatatcttgatatcagagataatgtcttggtgctttgtgaggaaagtgaaatatttgtcttctaaaattttatcttatgaggagaatataactgcttgtgaattttgtaattgcataaaaatataatggaacacatgcttttcttcacattttatataaaatattagctgccacataaaaaatgatctgtatgtttagggtcaaaccccacattagaaggctggcaaactttcggtagagttggtgttaaaaaacaaatagtaaccgccttttcgacattaaccctcatattagctcttactgtagctaatgttaaccacatgttaatctaatggcatttctcttccttcttctcctttactagtaaaatatattaaaaaatcaactgctgtctttgttttgtttttttttttttttttgcagctttgtgattggccagattctttctgatcaaagccgggacactatagtggaaaacattcagaagaggctgatagaaattggagaaaatgtgctaaatggcagtgtcccagtgagccagtttgaaattaacaaggtaaatgtagcatttattgctgagcccagctgctgtcatgtgtttttcacctccttcagatagttgaagaaccacctcatccttgcaattgaaataaattctagctggtgatgaaagctgcttaacaactatctcacagattgagtattagcatacctcttccagccacaggtactgccatgtctgccacagagaccttctctgtctagtccttactttaattcttggaagacttgtttccagaggtcctatggagtgatacagtttacattccagaggtcctatggagtgatatcactgtatcactccataggactggagaacactactttcttcatagttcccctaagtaatagttgtttggagtgtaggcctgtaagcttattgtgtgcatgtgtgcattcatgtgtgtgtttaacttcacagatggtgattcttttggggacaaaagttatttagggacagtcttagttgttgaaaatagggaatattttttcttacctaatttgaaaaacagaatcttggtttccaaagtattgtgtaataaacaaaatgttaggttacaaatttattcccattttagtacccttatatattcagaagctaattttgcaaatacaatgctacccattttgtggtagatttcgttgtcaaagtgcatacaaaaaaaataaaagaatctaatgctgacagtaaatggaagttttagaatgaagactcattcatagtactctgtgctaatgtaatgcttgtcatttttgcacatttctgtactgttgaaaacatttttatattgcagcaattacagtgttatttagaaatatattttcatttaacataaacattttcccacatttttatattaccttaaaaatcaaattaatcagtgtattaaaaagatgtatctgtttcactgatacatctttatttaaatttgttgattatttaatgttttctattataaataactctattgaacatctttgtttatttatctttttgcatttggatgaattactttcttattttaggttccttgaaggaaaatatttgagtcaaaagatgtgaatatctgtatggcttttgccaaattgctttgtaaaaggatgataccaattgataatagcaaaatatgccagtttcaccacagttttgcatgtagtggtgatgatatttaaataaaactttgctaccataatgaatatgaaactgtatttcacagttgcattgaatttgcatttctttgattcctagaagggatgaatattttcttacagtttatgtttattcttaggtaagttgtttcctgtaccttgactatggcatccttaatgtcatgaaagaagacatttgtttatacattagaaggggacaatgtttcttgtcactggctctccactttaagtgatgaagtgtacacatattggcatggaatcactgtgtcatctagaaagtagattccttttagattttgttttctttctcaaaaatttatatgagtaagagttacgacttaagacttcttttggtcagtttttgcatcaattctgcatattgtatccctgatcctgtctaccttcctagaaacttgggtttctatcacaagggcttccagggatgagtttgggagtgtcagtcctagcatgactgcataattggcaaaataacactgaacacatctcctttagggtagtgggcccacactgtaaccccctcatatgaatgatgacacaatattactagtgtgcaaaaagaaacttagagtcataggtatactgacagtgtctgcattcttttaagtttttattattgaaatttctagacttatgtaaaagtagagagcatggtatcatggatcctcatgtattcattagtcagcttcaataattatcaacttatagtgacattctattattaacaataatagttaatacttagtgtctagtatgataggggctgtgaatagatttttctgtggcagaactgaaactgtgacttactgtctttatattctccatatcacttagcatagctgttggcaagtagtagttgttcagtaagcattgaaagaattcatttgcttatttaatcatccattcagcaaacatggagtacctcttatgtacacaatgctgattctgggatataaagttgaataaggaatacgtggtccatattttcaagatgctggtggtctattaaaagtatttactgtcggccgggcgcggtggcttgtgcctgtaatcccagcactttgggaggctgaggcgggtggatcacgaggtcaggagttcaagaccagcctgaccaacatggtgaaaccctgtgtctactaaaaaataaaaaattagctgggtgaggtggtaggcgcctgtaatcccagctactcaagaggccgaggcaggagaatcgcttgaacccaggaaacggagattgcagtgagctgagatggcgccaccgcactccagcatgggcgacagagcaagattccatctcaaaaaaaaaaaaaaaaaaagaaaagaaaaatgtatttactgtcccattattcttaactttcatttaatagagaagaatttctgcagtgttgatgcaagtacagtaaattctgatgaaagggctatctttattgtagttctgtatctatttacagtaagctattcatttgttaaaggtgatatatcctgaacatctttaacatttgtctaaatgcttgcactatttaaaacttgtgagctattcagtttctacattttactgcttcgaaaggagagtggaatggaagagtctatgtatgtgactggttgtggatggtctcatgacaatatttttttttttttttttttttttaggtgatgctggtagggcttgaaaatgacaggttaaattagggtggagacatgcatgaagtgatgggatttacctttagagattttagcccgtgttgccaaaagcaactgaaaaacagcatgtgtgattttgctgaactactgcaatcttagcttaaatatatttcacaaagtaacacaaaatactttgcagctgatttttatagctctggctaacttgagcctaaaccaccaggaagcatttttttttttttaaatgaagccttctaaaactagcttgtaaagtccccaaatagcctacatctaataattggaaagtatgtcagctgaaatttagaatttcttaacattgcactgaagaataatccattgaagaagataatggatttcttaagtactgttatatcagttaagatttttatattgtattgcttgtccaagacaatcaaaacttcacgtattccaagtttgaggagattcaaatacttgggagagtttcctaggcactctgctaccctgagtatggaatttagtaagtttacataacttgggcatgtgcagccatgtttgaggacctgctttattcttctacatcagttctcagatttcttggtcttaggacacctttatactcttaaaataattgaagaccccaagagctcgtgttgatgtggtttatctcgatatttagtgtgttagaaatctaaaaacatttgttaatttatttaaaaatagcaacaaactgattatataattacaacaaatagcatttctttctatgaaaaatagctatatatttcaaaacaaagaaaaatttagcctgaggagtggtatcattttacaattttgcacatctctttaatgtctagctcagtagacgacatctgggttttcatttctgcttctgcatacaatctgttgtgacatgtggtttgggatggagtataggaagaaatccagtttaacccaaacatgtagttagaaaaaggagaagtattttagtattttttttctgatagttgaatgtattcttctttgatcctgcaccagacgtctacagatggtattttcttcgtaatgtggaatctgaagccatatcaatgaacttttcctgttctcttatattaaaatctgttggtctctgttgtactttgaaagaatattttacccatgcgtggcatgagttgatcatttgttaaatgttggttccctgaattatacagtatactccaaaatagacacattcattgtacaatatcaaaaattacgttttaaaatattcgtacttatatcagaaaagtttttaagtattgggaagctttccggctcacagaagtagaaaagttttctaaaattctaatttgcacttgaaagcttgaattttatcattgacaatatatactgtcagatttttttttttttgccttgaagtggcaggctcactttttttttgagaaattgtctgccagatacccaagtcagaataacagtagtttgcccattattctttcaagtaaaaattatattctgtgaaaaaggcagctagtttagcttgcaactcaaacagttgcacaaatgctttcccttgagcaatctttgtttttcagatgtgccttgtgtgtactttgttttatctcacaaaatagtagacttgtactcaagggttgagagctgtttttttttgttttgttttattttactttaaatcctgggatacatgtgctgaacgtgcaggtttgttacataggtacacatgtgccatggtggtttgctgcacttatcaacccgtcatctaggttttaagccctgcatggattagatatttgtcctaatgctctccctccccttcctccctacttccccggcagaccccagtgtgtgatgttcccctccctgtgtccatgtgttctctttgttcagctcccacttatgagtgagaacatgcggtgtttggttttctgttcctgtgttagtttgctgaggatgatggtttccagcttcatccatgtccctgcaaagaacatgaactcactcttttttatggctgcatagtattccatggtgtatatgtgccacattttctttatccagtcagtcattgatgggcatttgggttggttccaagtctttgctattgagagctttaaaaataattcttactgtttcatcaaggacattcttaagtgaaagtgtttttttttaactatgcatggtggtgaagaatacagtgactgttagtacagtttgatagtaccatcctgattcatgtttataaggcatcagcagttttgcccactattgcttctgtatcatcagtacaggtagtatcgttatgaaaatagttttgatctctggaccccctgaaaggatatcaggaactcccagggctctgcagtccacactttgagaacgggtgagctcatccagcagtaccctggtccccatcctttctcttgtcttttgaaacctaccccttccagggctgggtatccccctccttttctttatgcatactgagttccagtctaatagaatgcgtttttttctcaccttttgcctttttgtttgtttctctgcctggaatattcttgcccccattaccttttcttaaaatcttgcttttccttctagtgccagcttagttttttcttccatgatttcttctctcaggtggaaatcattcttacctttctaagttctctccataacactttgttcacatctcctttatggcacatatagcttattttagaggttttttttttttttggaggggaggtggagggtagagagtcttccactaatagcagatgactgtgtcttattcatcctgtggtactttataatactggaacaaattattctgagaattattacagatggagtgaaataatttattccgcaaatatttggctgctactgtatatcaagcatcgttaggaacactgtgcatgcagttgtgagcaaggctgacattgttcctgttctcgtagtacttactttctgttacaaattcattctacctctgtagaggttgattgacagcatgagtaaatccagtgatttctagtgcctttgggatttattaaggccagaggagcctttgagaaacaatcattaagtcagagtagccattattcatcagtcccaactgatcagttaactcagtgagataattgcacacattaagactgcatataacactgaatttatagtcttaactttttatgtctaagtatcatgtgatatggcccattaacttatatttcttttttgttggggttgcatctggttatgttagttattgaacaaaggagagaggagtcttgaagatgggatgtttaaagattctgtagcaatattttctacatacagcttctgtcattttttatgtttatgtggctagtatgattctagcaaagatgtttttagtgtatatctgtgtaagaagggttttattttaaggcttagaacttttttgttccctcttttaggcattgacaaaggatccccaggattaccctgataaaaaaagcctacctcatgtacatgttgccctctggataaattctcaaggaggcagaaaggtgaaagctggagatactgtgtcatatgtcatctgtcaggtaaactattgacattcgtaagactctgacacctcttaagaactgaaagtaaaatccaaattaccacagtgtcttatttagcattctccccaataattgatgttgtaaagtctggttagtttcatagcatttaaaaaacattagaggtgtggcatatgtcattaggattttcataaaacatttatgacagatttgtaacagtagctactcttttaaccctaaattaactttaatgcaaatgtaagtttcgccatatgttcagcagtagtcctcatttatctctttccttttgcagcagttcccattataaatatcagtggaataataaaagaataaatgccattttttccctagcaaatgtccaaataattatgtgaaaaaatatgaactacatgattatacggagaagttgagagatcctatgaacataccctatgaggaaaccacacaattcaaccagtttttttttttttcttccttcaagtggagagggcccacctccttacccttccttctccgtttcacaaggtacctctaggccttctggaacacagttttaagccactaccagttcttttgataatagcatgcctataatgggtgaggagagagagtaagagagaagagcagttttttgactttcgaagcccttaactattttaacaaaggagaggtctcatcccttctatctgtaaagataagtcagggtcatagcatttatccaaattctttcaaattacaatggtatagactacttaccataaggtataatttatctgaataaaacttttttaaagaaattaagttttatcctaattgttattgcattgtgttgttacagtaaaaaaatgttttacataaacctaaaaagtaattgcaatatgattgatatttgtcaaaccacaatcaatgtgtttttaaatcagagtcttttgaaaatttaaaagtagtctgctgatacctgctatatgctgtggatgtacataacaaatgatttaagtacgtggacaggaatcagcacttgactctgtctcccccctagggttacccttgattaagaactgttacagaaagccaattcctgcaggaaaatatttccataaatgtctgactcgctcaagcccttaatgtgctttgcatattgcctctgacaagtctcatctcaaaaaaacaattttcatattatgcaaataaagattttggtaaataggctaggtttttttttttcacttatgtcttcacatacatggaaaagctcttagattggtgatgagaagaacagatggcagcatacaactttgaaaaattatataggttcagtgaaatagcattaataatgaaatcaagccacaattgtgttttggccaaacctgcaatgaagatgtgtggtaacttataaaataggatgatcattgtatttaaaagtctgttttgtgtcccttgatgtctgaatgttaggtgttaaggttcctttttctcaggtcttattgatatgcataggctcaaaatgctgttgctaatgtagtacagtacatccaattttatgtatttttagcaatttccatccactggtatgtgccttatttgctttttaaaagtatgattcatatttctttttattaacttattctccttaacatatcccaagaaaacctataggactttaatttgcctttgtaccctacccatgggacatgctccctttcaacctgtttgctagccaaatctgcctaaattttttgcttttaagcactcaaattattctgtttcataatgcagccatatttttagaatatgcttttgaaaatgtatcatgacacttttttttttttttttgagatggagtctcgctctgttgcccaggctggagtgccgtggcaccatctcagctcactgcaacctccacctcctgggttcaagcgattctcctgcctcagccttctgagtagctgggattacaggcacgcgccaccatgcccagctaatttttttgtatttttagtagaaatgggatttcaccatgttgaccaatctggtctcaaactcctgacctcacgtgatcctcctgcctcagtctcccaaagtgctgggattacaggcgtgagccactgctcctggcccatcatgacacatttttaagaggactgtttgctgccttaagcaagggtgtcctccaagaatagcctatatcctaaacaggttttgttttgttttgtttaaaatttacgtttaggaaatagtaccctactgataacttattcagatgggttcagagagtaatgtttttggtatgtaatttatattgtaggttgttagcgcattaaacctatgtgaattatttgctcagatcttaaatcaacttccatttgttggctaggttttaaatccataactatttaactttcattagacataatttccataaggcatgcctttaacataattattttaaggggcccacttgtctccagtttaaaatattttcccattagtttcctactaacgatgactacctagttttgtatgaatcgactgcacctggttgtctctctgaagtatgtactttgtgaagttcacaaattactacatgggcacttgaagaagaccagcgttgcttcttaatctgttcttaaagatgtatgccacgtattcttgcacataccatggggccctgctcaggtttgagaatgaaatctttgaaggttattattatttttttttaattttgagacagggtctcgctctgtcactcaggcaagagtgcagtggcatgaccacagctaactgcagcctttatctcccaggctcaaatgatcctcccactttagcctcctgagtagctgggaccacagatgcatgcctccatgcctggctaacttttttttttttttttttttggtcaaaaaaaaaaatgggggtctcactgtgtcacccaagctggtgttgaactcctgggctcaagtgatccttctggctcagcctctccaagtactgggattacaggcatgagccactgtgtccagccgaaggatgtatcttaggtcatagcctaaatgtttttccaatacgacatagcaaaacctgtcatctaaccaagtcttttgaatttagccatgttcgagcttagatttttaaaataccctaagaaatatgtttgtgtcactttttgttaaaactagtcttttgtgtgaatatttagaataaaaacgttttaaactgaaagcatgctcagaaagttttcaactgcttttttgaaaaccatgctttactatgagaactactgaaatattagaaagtaactctaatatttttaaaggcaggtgcctttaaaaaatattttacatgtataaattctattttaattcaccattaaaaattgttaaactcaacattgctgtaatcttaagggtagaccaatttttcataattccgtaaattgttcagattttatgtgtttggtaaaaggcagtctaaatacaattgagttgtgtgaaaagacactgccggaggattttttcacgtggtttttatcattggttgtcaccttattatcatcttaacaattcaagcttctgaaagagcaagaattaaacttgattaattatgcctaattccttttactatgttgtaaactcctgacaaataataataagtcttttaatctgagtttgcttcctttttaggtatttcattttgtcttagaacaggtagaacctggttgataaacaggcccaggttgttttcatcaggagcctagccagaaaaagaggcccctgcctctggtctctggtaaagacagtggtgtgtggaaggttgcctctgctttgggctgggtgctgagctggaaagggactgattgtagcaggaatgaaagaataggattcacattataatcagttctgctgagcagctgagcactgtgaatagttataacttactagtttgaatattaaattctgtttcagatgagaggaagagtgagtgagttgttggatgttgatccagtagagataactttttggttcagagatgatggtgacatcattcacaaggctggatatgggccaattatatataatttcacagcttttatttttatagagtaaaagagaaaacccttgaaaagaggctttctgacccatcttccttttcttgaggaggaaccaggtaaatgataccaaatgacatgcccttcattccagtggccagatatttggcttttagagccctgccactctgctaggacactacgtcatttttacttcttactgtatcttgcatataaattactactctatagatttcatttccccactcttttccacttgttcatttgcttctcagtgatacatggctctcatagaaaatattactcccgggatctttgagttactttgactagaattcttgcctgaagggatgacattaacataataaaaaagaccatacacatgtttttaaattatcactccttaaaaagcctttctggctacactaattgttactaagccttctcagtgtttggtgatatggcaggtgaaattatttaatctggtcattgctatcttgttggtttcaagtttttgcaaaaaatagaacacaacatatactggatttatattcttggacactggatgagatctcaagattgagatgttgtccttgattttcctactcaaaatgttcaacaataggtcaaaaagaggtcttgatgtttagaagtagatacataaaatttaaattgttgcctctctgtttgaccaagcaagtgtctgtgattgagttgctcacaactttacctgtgtcttctttttacgtgtctttttatcatatcttcttttaggatggatcaaacctcactgcaagtcagagggcctatgcgcctgagcagctgcagaaacaggataatctaaccattgacacccagtactacctggcccagcagatccacccagtcgtggctcggatctgtgaaccaatagacggaattgatgctgtcctcattgcaacgtggttgggtaagtgtcccaagctcacatagaacctcacatggtaacaggggcacatgtagtcttccttgtctcttgagatctctgcttatgggcatggtattgtgtctggcacttctttgtttatagtttagaatgtatttttgtggttgtttggtactgtctccactcatagactatgagctccacatacttgctactgtaaccacatgcctgcttcatagttgatactcactgaatactgagggaagagagggaaggcaaaagaaagggtaaagtgaagatttcaggtgccgttacagtcaccgagtttacattgttatagctttaattagtgtacctccatttataaggagattgatgctatcttgattattggttcatcttgtctctgtcgctgaaggtattttcatgtcaaatgagaaaacatggctttttaacatgaaatttttaatttttaatattcaattcattgtgagaatcctactctataagttattctaaaaatggacccactgttatcctctaggaattggctgatttctaagttatcatcatccgaggaggtaccagccaaccctgagacctcagtattactttggctttttgctatgtcaccagattgtctccgttgctgtgtcattattacttttgttatcttttgcttagaaatgtatttcataaccagccctgatttcatttttagatgaccaagtacataaagagttacattgcttttaaggcctttcctctctcttctgtggtaagcaaagatgagtgttttcagagtactgcctaatgtcctgagatggctcctcactatttgtaagtcaagcccaggtgccactggcatctcacaaactcttaactttggcaattatagacttaactttccagctcccacctatgtatccagccttatttcttattcagtctacgcagtgtctcccaaatatggcactgcccattctgtccctgcttcatggaagattctccccctctttttactaaaacatctagctttagccatgggctttgacagcatagggacccgggtttcagtgctggttctgctattcacaagcttctgaaccttggtctacaccttagctccttgagtcatggaatagagttactctgagggagaaataagatgatatgtgtgagatgttcagcacaaggtctcgggcaaaggaaggactccgtgagtggtagccacctcccacccttcttttaggcgtcagtagaaatatgttcatattccttcagtctgtaagatttgtatatacttagtgctcaactacgtttgtagaatgagactggcttttccatcggtgaattatcaagtcacatattttctgtcctgcacctgttcagtatgtttctgagctcctccctgctacccccatcgtcactaccccgtcaatgtttactctggaagtggaagctcatttttaacatttgcctaagcaaatattaggaagataaaattctaccaccaaaattatcatatgtattctccaagatgagttgtatttgatgatgtttataaatcctcagctgggaagagaggactgtaaaagcaaggtattttttagcttcacttttttctctgctatacattgagcgtttgctctgttggatacagtgataagtactttgcatttgttatctcattcagtccttgtgacaacctcacaaaggtatgttggattaactccattttacagaggaagaagccaaggtttagagaggtaactatcttggtcttggcacataggtagtaagtagccggctgtgattccaaaggttgtgatcttaactactgtgctaaacttgattgcctgttcttagctctaaaaggctatgaaagatgttttcaaccaggagcagggtggcatagatgtataagcatggggggcttcatgtttttcttgctccctctatttctcactgtactcccccccgctctccactgaaaacctctgagtaaaaccattttttaaagagtagatctccgagtttttccatttgtgtcttcaaaaacctggtgtaaaactgttgcccttttcttctttggttttgaattttttggtgacccagcactgagaggaggtagatggaacaagccttgtctcatgaatgacatttaagataaggacttgcgtagccttgtatgtcagcaaaagagctgagcaataaagggtgatggagcctgcttgggtggattggcctgatgcctgcctggatgtgtcaaggccagacatactaagagggaccagactgattttgttagttccagaagtcatagttaagatgatttttgtttataaattgaacagtagcagattttgacttgacagatactttattataactgcagctgctgtatcataggctgccttatgaattcagttttcacaaattattttcaaagccagtagtagacaagtgggtcccatcttcagaagtttcatgttttatctcattattgaccaatctcaatctacacagagaaccctccagacttgcacacggtcccacccatatacccatcactcctgcctcacaacctgaaaattctctaggtgcagccatggctgtgtggacactcttctgggcagtcccttcttggtgccatgtagccaagtcaagctgatgggagggaatgtgtcctcggccttgagggatctgcaactgctcctcacttttggctactttttctcattttttttcttctgccacttgacagtggtttttatatcgcggatgtgtgaagttgtcatcattgtgtagtcctcctctcctgcttgtcctcttctctcatcctaccctgtgcctgcaccagcagtatatacacagccatctatattagtaacaaatcttgtagtcctttccttctgcccccttccaggagtttcagcattaatgaagtgtaggcccacaagtccccatcatcatgaagatctgtagaaaacattgaagctcaccaggcagatctctgcaggcattagcctcctgctctattcaggagctgaatttcttatctgcaccctttattcctctaccccaaataaaaaattagggtggctattcagtaggggcttcgaggcccctgttatcagttctactgtagcctgtgtatttaggaggagggagggagatggggaagtggtggcaaagtaagagaagtgttagggggtacgtggtttctaagaggtgcaagctgtaggcataaaattactgtaatttgtttttaaaattctaaatctgttttctttatataaaaaaactgcagctagtgaactgacaccgttaaataagttgaagtatacaaatgtatacataaaatacaagccctccaactgcctaatcacagacataaaataattctcttgcttttaatgtagtttttatctttgattaatgaaatgtattgtagtattgaaactttagtgaagtttgatactttgtccttttagttagtacaaagaaatcaggaataatggcataatttcatttaggaaaattattaagctcatgattttttatttttaagactcttttgtggagagcaagtatatttttcaactacttttttctttctctattgcttttatactactttccttgaaatgaaaggcaagcatcaagtgttggtttatcctatggcttcactttggaaattctctatttctccccatcaagatacctcctgaagtctgtctggtggcatgttgcatggccaggtgttccgtatggggagaccattttagtgaaagggagagaggatagcctattaaatgagtgaatgaataaggctcttgaattgaaagagaataatttgttctaataactaatggtcctcattatcccacagtaaaatatgtatcatttttctgaaacccatgcaagattattgctattgggcttaaataaagcaaaattttactcttttccatctgtgaataggaaaaaatatagtattactcttcttatacaatagccctatgggaaacatggccactaaaacttgaaactcttagcttttgttctctagactatagatttttctctctctcattctattgaaagctctcccgtattctgtggatgaaatattcacagtatgctcaaacatccaaatagtcttccatacctagctgactaggccagtgatgagaatagtctaaagttcatttttgaatttcatctttgaataaatttatgttttatgtataacggtacttagaattatatgtaatatctctcctccaatgagcaatgatttgtacagtagttataaagaacctttcttcggggtcagtgataaaatttcaggcatttggctatctgggcagttttctcattggtcctgagaaattattgaggtttgaagaacatgagaatttagaatttaatctctgaaaatactgcttaaaagaagacagaacacacttaacccagtgtgttctgagttaaattggaaagcaaaaatttccttttaaaaaaatgatgcataccactcatatcacagaggttagtttttgtcagtagacagggttcagtaatatcatctaagaaataagtgcgacagtgggtgaaacagggccaagcgatgtttgggggtgcttttgacagatccagggagatccacctacaaaaaagagagtaaagtacagatgggtaggggtagaatgatgccgccagtgagtacttcaggtattactttgtcaataaagaattttgccttttttcattattaagctcttataaaaataaaacatgaccatttccaaactgtaaatattttctttttctgtctttttattttttatttttttttgagaaagagtcttactctgtcacccaggctggagtgcagtggcgctatctcggctcactgcaacctctgcctctcaggttcaagtgattctcctgcctcagcctcctgagtagctgggtttacaggtgtgtgccaccacacctggctaatttttgtatttttagtagagacggggtttcaccatgttggccaggctggtctcaaactcctgacctcaggtgatccgcctgcctcggcctcccagagtgctgcgattataggcgtgagccactgctcctggccccaaactgtaaatattttctataacataattaatagtaaaattaaaaaatgttataccaaatgcattgcagaatgttaaaggaaatcttatcagctgataagagcatctcttacaagatggagtgccattccaagcatatcatccagtggctcatgctcccagtctagtctacttttgtattcaatattaattgaagacctgctgtgcctagcaccataataggcactgtgaaggatacaaagttgagtcagttatggaccctttattcaaattacagcccagtcatttcgttgatttcactgttgtgggcaagtctagtgggcaacacagtgtatgtcccaaaaaaggtgaaataaagggttatcaaatttcaaaggaagcagaaaccactcctagctgggcccaccacggaagagtttataaaagtagaggcattttgaggcattgctggaatgggctgtggagaggctagtgtgaagttgggaatggttgcccaccctactgcttaccaattcttctagcctgatgaactgcaggggtaacctgtgttatctcagccacccccaaagcactttagggaattcaaagagagcctctttaagggtttcagttgaacggtcctgcatctcagtctcaacaaagtgagcacacagtgggttgcttctgtgtcgctagcccacaatagagggccagtagtgacactgctcatctcacataagcagtgagacctttgagaactttgaaccaaaccagagcatgtttagaataattgctttggaacttttgtatgagttatgtaacaactctggctttgtaacacttagaggttttaaaggaaaattgcggatttctcaaattatttaaattagatcaattttttaaaaagataaaattgttttaattaagtacaccaaagtgacatttatcaagatcgtgtagcttatagaaaaatggataagacctaaaaatgggtaaggataaaaaaagctgaatactatacagcattgtacacatacacgtacactgtattatatatgtgtatgaataaaatagaaaagggttaaggtgatgaattataggttccccctttgctgacaaaatattaatactgttattttattattaataagacagttttttccaaaaccagaagtaaaacaatggttaagcaattactaactcaccttcatttatttatttatttcagatggttttgggggaacggttagtgtttggttattacataaataagttctttagtggtgatttttgagattttggtgcacccaaagcagtgtacactctacccactgtgcagtcttttatttctcacccccatcccacctttccccccaagtcctcagagtccattgtgtcattcttttgcctttgtgtcatcatagcttagctcccacttatgagtgagagcataccatgtttggttttccattcctaagttatttcacttagaataatggtcttcattttcatccagattgctgtgaatgtcatatttttttttatggctgagcagtattccatggtgtatatatatgccacagtttctttatccactcattgttgggcatttgggctggttccatatttttgcagttgagaattgtgctgctataaacatgcacgtgcaagtatctttttggtataatgacttgtttttctctgggtagatacccactagtgggatttctggatcaaatggtaattctacttctagttctttaaggaatctccacactgttttccataatggttgtactagtttacattcccaccagcaatgtaaaagtgttccctttttaccacatccataccaacatctatttttttttaattttttgattatggccattcttgcaggactaactcaccttttagaaggtgggtggttagggaccttgagcctagctgtttttccccagcatctaccaacatagctggaagagaagtaggctgtgttataagacaagcaatctttggactattatttgtgttattttatattccaaatatatttccagcacagagttaccatcttttctcaggtttaaaaacaggaaaggaaggccaggtaccgtgcgtggctcacgcctgtaatcccaacactttgggaggcaggaggatggcttgagtctaggagttcaagaccagcctgggcaacatagcaagaccccatctctacaaaaaataccaaaattagctgggtatggtggtgcatgcctgtagtcccagctactcagctgactgaggtgggaggatcacttaagccagggaggtcgaggctgcagtgagctaggtcaaggctgcagtgagctgtgatcgttccattgcactccagcctgggtgacagagcaagaccctgtctcagaaagaaaaaaaaaaaaaaaaaaaggaagaagacacttgaaaagcttcctgccaagaaatacacatctcgttaagttaaaatttatatttgtgtctattgtcaagggcattaaaaccagttgattgaagtcatgagaatgctgctcatcaggctttttattctgtcaagattttgagaattatcttctccaggaaaataaaaatcttgggtattcatttaaaccaaaggctcggctattatttcttctaaaatactcagaaattttccatttatattatgaagaggtgtattgttggtgtgaaagacagttttggttgtctgacacttatacagtaaattgtttatctttaaattggatctgtagtattttaaaaacttgttgggctgggcatggtggctcacgcctgtaatcctagcactatgggaggccaaggcgggtggattacttgagatcaggagttcgagacaagcctggccaacagaacagggtgaaaccccatttctactaaaaatacaaaagaattagccaggcgtggtggcgggcacctgtaattcagctgctcaggaggctgaggcaggagaatctcttgaacctgggaggcgaggttgcagtgagccgagattgcgccagtgtcctccagcctgggcaacagagcgagactccgcctcaaaacaaagcaaacaaacaaaaaaatacaacttgttattatggaaaaatgtatattatatatatatatatggtagtagagaatataaaattttttctagtatcacacatattaaattatagggtaagattaaaccctcatatactcatcacccaccttcagtattctgcactggtggccaatcttattattcctctttcccaccttcccctattattttgaagtatatcctatatatttattttgtgtgttaatatttcattttgcatttccttttttttttttttagagacaaagagtctcactctgtcacccaggctggagtgcagtggtgcgatctcggatcacgacaacctctgcctcccaggttcaagcgattctcctgccttagcctcctgagtagctgggatcgcaggcatgcgccaccacccccggctgattttgttttgtatttttagtagagacggggtttcaccgtgctggccaggctgttcttgaactcctgacctcaggtgattctcctgccttgacctcccagagtgctgcgattacaggcgtgagtcagtgcgcccggcccattttgcatttctaaaagaaaagattccccttttcagcataactacattattatcacatcacaccaaaaaacctcacaattccttcatttcatctaatttccaacaagtgtttatatttccgtgattgcactatgaatacactttttttaaaaagctccttgtttggattggaatccagtcagggtcaacttggtagttaatttctatttttttttttcctttgttgatcctcccagtttgttaattaaagaaactgggctttttgtcctatagaatttttctcattctggagtttactgatcacatcctggtggtatcttttaacatgttcctctgtctcctatgtttcctataaatagttagatctaaagatgtgattatatttaggctcaatttattttattttatattttctaaaatataaaatacacacttcttcctaggcaatggggtttatgtctatttgagtttcaatgcattttgcaacaaattcatagatgtttcataagaaatatttagaatgcaattttctcacctttccaagtgtgaatttttcatagtataacatgcatacagaaaagtacacaaaacctaactaaactgcttgataaattttcacaaggtcatcatgcactagtgtagtcattactgagctcaagaaacagtacattactacattcccagaaggcccctcatgtctcctagaaatgatcctctacatacctggcatctaataacatagatgaggtggatttttggggatattacacaaattgcgtctttgttctttgtgtctagactacttttactgaatattgtttgtgagattcatccatgtggttgtccttcctttctgtaaattctgtataatatttcattgtctgaatataccacactgtatggctatctactggaggtacacctatgagttgtttccacatttgaggtattttgaatagtgctgctttgagagttgttgtacaggtcctctgtcaaacgtaagcatgtatttttcttggggatgtactaaggagaattgctaggccatcagggacatgtatgtttacttttagtagattctgccagttttccaaagcggttctactcgtttacacttcctactagcagtgtttgggtgctccacattcttaccaacacttggtaagatagtgttttccatcttcattttacatggtggcatagagttgtggttttaatttgtatttctttgatgactaatgaagttgaacaccttttcacatgcttcttggccattggagtatttcctttcgtgaggtgcctgttcaagtctttgtctgttgtcctgttggcttttctttttcttattgatttgcaggcatttcctatgtgttctaattacgagtcttttggaagtatatattacagtttgagtatccgttatctgaaatgcttacgaccagaagtgtttgggattttttcggattttgtaatatttgcatatagataattagctatcttagagatgagacccaagcctaaacatgaagttcatttatgttttatatacatcttatacacgtagcctgaaggcagttttatacaatattttaaaaaattttgtgcctgaaacaaagttttgactgcaactcatcacatgaggtcaggtgtggaatttttcactcgtggtatcatgttggcactcaaaacgtttcaaattttggaggatttcagatttttggattagggatgttcaacctacacaaacatcttttcctatttggcatgctttttaagagtataattcacataatttaccataaaatgctaaaatcttgagtattatacaatcagttatctaggcacagacacagaacattttcatcactccagaatgttccctcgtgcctcttcccagtcagcacctctgttatagtagcaatcgctcatctgaaatctatcagtataagttagttttgcctattcaagattttcgtataaatggtttcctacagtatatactctttttgtgtgcaacttctttcacttagcatggtatttttgagattcatctgtcttgttgcatgtagcagtattcactctttcattgctgagtagtattagctgagtagtattatggtagattataccagttaatccattcacttgttgatggacatctagagtgtttccatttttggctattatgaataaagctgctatgagcattctgtggatatagcattcaccatttgaaaattatttttttctttaatcatactaaattttcagttcgcatattgtcctctaagatgtccagatatatgaaagcctggactcatgcaaaagataaatggtttacttcctctaagaaatttttacaaaaaaatttcactcaatgggattctgttaattagcttccctcatagattaaatgatccatattacaaacaactgcttgtaaataccagttactccctttactcatttggaatttcatttatgtggattttccctcttccccacttgcatgaacatatgtaagggttttactgtagttatttgctgttgcactaatagagaccttgtcttttgaaggaaggaaagtatttgattaaatgtatcagcctctctaataacaatatgtctcaagttatgaacagtttaaaaactccttgggagtgggggcaggtgaacattctaaaaacaggcataatttacaatggttagaaagtgcaatggtagaaaaataattttgtgctaaatgtcacactgggggtgtgtgtgataaggctatggtgacttaagtaaagacagtactgctaaactcatacaccctgatgcctatgatgttactttctataaatacttcttgaaacatgagagttttgatcctgttgccaaaataatgtgagatcctagaaattttctaattataaatgacagtattttaatttcattccactgcctcttttgtaccctcaaccccagcacaaatgagtccatcactacaagccacataattgaattaaagcatacatcatctcagcctattctggggggaaaccacggctgctcttcctccagataactagttttgcaaagcccaggcaggctgcttcttccttcattctgtgcctcaccaaaagacttaagtcacctgtcaagagctagcctaaaagaaatggaagttacttttctcaaatggggcataaagtttgttcctttaagccagttcagagaaagctttcagtagaagcaataaggaatttgggattcagttttgcatttcttgctcaaagactaatgtacgcagtgtaacattaattatacggtgtagatgcatgtagggcaagtgcagtaataaagattttgctttaatgtcatttttgacagaagtgtttaattttggagtgacaacaattaaaaatggaattatatgtagctgctgttttgcacattttaaaattcagaatctctacctgtaggtggcagcaccagatacttgtttcttgtttcactccagacttaatgagtttagggtataagcagtaaaactttaaagtctactgaaacttcgaaataagctgctgttaccagttttgtgagaatttggaaaaactaatgtatgtgttgactaagtttggggcttatttaaccctggattttcaccttttcaaaaaagattccagcagcaatgatccttacttttttaacatgacattgtatgttttcttaaaatgatttaatttagccctctgtggtttgcctgttgaacttataactgctctcccaagaaaataactttttaatggcattttggtatttaagtaacttgtacaaggatcattatatacctaatattttaagctcattacagtctcttctccctttatatttttacattttagcattgaactatgaccaagagactattgagattgaagctccttcccctggggaaaaaaaaaatcaccttgggaataaatctgaagtaattagctgagccagttgactttgttactgccatgggaagattgagtgatttgtagaaatggatatttagggtagacatttagagtagacatttcacagggcctggtatttttcgcaagttgcagccagtcgtttgggtgtttctccatgagtaagtaacaagatggcccacacccacttttagcttactctgcaggcaggctgtcccgggtcagtgcttgcaggttcatgcactcaggtgcaccaagtgagccatggctggtggggaggggtagagagtagctcctcttggttccttttcgtagcctggccaattttgtatatgtgcaaaccagcattgttttgttcctttatttttggactgtgaaagaaacttgccttttagaaaaatcttgcttattttctttttccttatcttttgattagtgttggcctgggaaattgattaatagtcatagggtcagagaaaaagtgaagctgctttctcataattgcaaataaatcaaaacattatgtgaatacttggattcacaactagagtttgaattagcgacagttacccctcactacagagatgaactggcctcattcagcggtgtggtctctctcaattcctctgaccatccttagctttaaatgtgagagtatatgtattcccacataattctctaatttactatttctcttaggggttaggtaacttgtaaaataagaatgtatagtgtcttggtgacaagtggcccatgttaacataatttatgtcactaatgaagaacagcttttcaaattgttctgaatgtgtattctttgtttttatcatatactaccactttaggaaatactttaattcctacaacgagtagctattaacttcatatgcagcatgaacatgtctcatatagttttctaaatgcataatcttgagcgagtacagtctggattaaatgatgttcattcactattttattttttcattgaaatgacatttatttagtgcttgccacgcagtaggcagcgttgaactcggtttgttctatattatccaatttaaacttcaaaagtgtatgatcagtgatgctacctccgtttcgcaggtgagaaaagtgagactctgtgtctcagttgtcttattctttgtttggcccctttcaactgtgaagagtcagcctccagtattttataattactagatgtcgcttgacagctgaccaaataggatttaggattctgtcactgaattctgaatgcatctgttagatttatctacctatgtagctgttgataaattttaaacaatttttagatatttttggtatttgtgagcttttggcttagtgactgttttatattacttatttacctttatactaaaataagatagttttctcttagatttccaaaagcttttccttagatttccaaaagatagaaatattgtctcttataatcttttcttgaaagcatcccttagcaatccctaaaattctaagaaacagtgtagaataattatttttaagtataaattcaaatagtaaattttggcacacatgttttgaccaagggtaaattaaattggttggcctaaaaatgtttcttttctttaattagtttgtggaaacaaaatagcataaacatgcattgattgatttcttatgttgttttgaatgaaatatggaaggtatatttggtttcaggattctcagggacattttggcctgtagaatctgtagacccattgtttttgcacatattttaaatttctgaatttcgaacatcaagaaaaccatgttgcattttgtctcagatgctgctactgaattttaaccactgaattagattgcaacctacatgctgttaactactgagccaagatgaaatcgactactgcattgaaatcagggttagctgtgtctgcacttgaaggagttgtaatggcagtgaacctgttttctttaatgggatttttattccctgattttattctcagttttaattgtgactttgattttaagagaatttcttagtacacatttatttgaggttttcattgtaactttaagagaataataaaaaacatcctatcgaagtaggtgcttccaaacccatatgttcagtggcatatttctgtgttgtgttgttgcagttacttgttttatttataaagtatctcttgtaaaaagagaagtcatttgtccatgtgcttttgagttcaaatggttgtgtgtatgtgcatgaatttaaaataattttttgtgggagttttcttctttggggtatttttggaatacttttctgaatttgtttttttcttttacattaataggacttgaccccacccaatttagagttcatcattatcataaagatgaagagaatgatgctctacttggtggcccagcacagctcactgatgaagagaaatacagggactgtgaaagattcaaatgtccatgccctacatgtggaactgagaatatttatgataatgtctttgatggttcggttagttgtttctgtctttcattttgtgagtgaacttgtataaaggccttacccccttcccccactatggggtatataaaaagggcgaaataaacacacacatgttgctttcatgtgtttaaagaattttagcatcatgtgaaatctaccttcacagcttgcttttatttctgtttgaaaactcttacttgaatgtgcttgaatattgttttggcttcctagagtgcttgaccttggtttttaagtggaatcccttaaaaattctaaattatcttaaagtatttttattataatttcttaattagtaacctgtattgtcccactgtcaacccccatctattaagacttagaccaatatttttccttatcttaaatcaagttactgggaactaagtgttttgggaaagtttgtgtttgtctttacacatcccacttacctccattttgcaaaggtactcttatcttttctgctgtctttgcatattagacatttaaaaagtcacagggagacattcctttcaagaagtactgccaaaaaatgtattattgaccttggatcagagcttgaaacttggccaatttacttgatttccactgcagtgttatgcatgtactagccattggcaaaggaataggcagcagaactgtgtaaaaccttgaaactgaaagaaaagacgccctttatctaaattaaaagtaattattttaagttaatttggacaaacagcagatgttttgcatttttttgaatcaaaacaaagcagtctttggaagcaagtgcaaggaagaggcagacacagatcagcaatacttgctaaatccttgagttttgcttcattacagctgtaaataagatagttaattgcatggaggcttgacgacttgcagatgggctaactgtggaagagccgatgtcaagctctgaaatctcttccacctggaattgcttagcgtggcgggtagggttatgtaccagattggagcaggaaaccaagatgtttaagtatcagaaaggaaaacaaatgcttcagaaatcccaacagttttgctatatattacatttgccttgtctttgtttaaaacaaaacacaacaaaacaaaatgttttctccaaatattaatatttatttatttcaaatttttacttctcctgcctccctcccccaatacacttcattttttggaaaaattgccaaaattttagatttgctaagcagacagtaagtgatactgtttttgtggtactacacttttaacttttagactttatttttaaaattaacttgacaagatgaaaacaaactaatgtgataaaggctcttgtttttcttcaagtttgtaatgaataaatacaaatttaaagtttttaatcagtatctctgagaaagaggtttatttccagtaacatgacttcactggtatttacagagggaaaattattttatccatagagtccctcgtatagtgaatgtaaaatagtgatttcagggttttccctttgactttgcactccattatgatgatggcaaggaatggaaggtatgtatgactaaagcggtctttgggaggaaaataattgagaagatagggttaacaactcaccaataaaacgaattaagaatattcaacactaggacagcatgtaagtttttaagcacaaaaacccttttatagcctcacagtaattttttgtatacttctcctgacttatgtagggaacagatatggagcccagcttgtatcgttgcagtaacatcgattgtaaggcttcacctctgacctttacagtacaactgagcaacaaattgatcatggacattagacgtttcattaaaaagtactatgatgtaagtatccataatgatattcttacatacacaacttattgaggtttggtacttgtttattggttttcatgaaactaaaattttgaaaagacttttgggaaaaattcctagtgaaatactattaatacaaatatgataaagtatgtaattttggcatattagcatgacaaattatttgataatttctctcaggcattacatctctttcatttacgagcagtattttaaataatgaaatttttacttcttttagaaaaagccagaatataattaagaaatgttttagtttattgttacctaaataagactaattaaatgattgcttagatctttggataaaggaagaaaaaaatcactattggctattgtcagcaagtagagccataagatcgtgtgtagtgatcttagtggactgcccacacaaaactaatactttgtgtttatgtagcactctaaacgactccataccctagttttttgaggaaatcaaatatcttttaaatttaaatgcagtttttctggcattcaaaagagaatatctaatttttataaatttatagtaaaaatgccagaacagtgagtgatttgtcttcattggaaagaaggcttttattcagagtttttgtttttaacgcatttcacatgaattagtttttttctcttcaaaaattaaaaatttcacatttcccacgtgatttttcttagtgtttcagtatgtcatttgtcatctaaacaaattttctgttacttgaaagtttactgtaacttctttttaaaagctacattggcaacacatttcaaaaaaaaaaaaaagctcatgtcttagttaaggcctatgacttttctaaagattgttctgtactttttactcgtattagttaacatataatagcattttcttctttaaaatagaactcattatgtgaaaagtaactatcagatcattaagatgaagagtaaaaacatagagttccagtattatgattttggtgttgaatatatttatcagaaaagcaagtcagtttgcctaaagattattaaaaaataataattatgactacattttgggaaaatctgaaacattttagtgaataatcctgtgctgcccttactgaacagtggatgggaataaaagttggctgtggggtcacattcctcagtaggtgagatgtgcagcacatgaaaatttaggccaaatcaaaactattcagctcctcatttacaggcctcattgaacagagtatgatccttgcttgactcttgggaagaattctgagctttctctctgtgtttagtctatcaagatcttcaccatggaaatgttaatactagaagaaacttatctatttccttctttaagagggaatagtctgttttgactaagttgcaaatactctgaaaaatgatcttctgtatagctagaaatatgccctgactgaaagactgatttctaacctaattgtgtgtatgttgtggtggtggttatataagtatttttcaagctaaataacctacttttagggatccagatatttaacacaaggtttctagagcatttgctttaattgtttttttgccagccatctcactaacatcaagtaacaggtttttgtagttaactgcccacttgattgacatttctaagggatttctgatcaaaatagccatatgtcactcctggggttaaaaattgatatgactgtcttgaaaattaggaacttatttctctactttctgatctgaattatatgtgattggatggcagagaacgaaatccgttattcgttcttatggcctcatgctaaacaaatatttcaaatattttccagatcagagcttttgtacaaaaagcccctgtacctttaggttctactttattggtagaccatcctgtttcctcctagaggtacatggcattgagtttcttttgttattgtgccttgagtgatactgattacagttattagttcagtgtgatatatcatggtgatggtaatccaattggagactaatctagcaagtgtactgaggtaaggatattgatagtaagtattgaggttaagtgattgtctctgaagctaattaccaaaatggttttctcctatttagcaacttaaaaaatactacccactggacataaaagttgtttgtgaaatgaaggcaagaatctcaatattgttttgattttagtcttagaagcactgcaggagaagtcaacctgcactgagaaaggaaggtatcttcatgagaaagggactccaggaagatgaatggaatatggtacttgaccaaacactataacctgcgaagaagcatagttctagatgactaagaaattagattgtcaagaaaaaagggacaaaagtttggggtaacaaagtatacttctaaatcactttaattttggaaaagtacatcacattctgttaccttctgtcatgaattaacaggactgactaaatatgatataacaaatatttgtttaagtttatctgagaagcaaactgtatcacatcataatattttaataaatattggctcctttatgggagaggagaggctttttgctcctcatctgtagcaatgattgtattccctgaattctagtttcctataacatttaaactttgatatacatagaaatacagaaagcactgagccaggatattttaagtaatatattaatttctttaggaagaagataactctgtgctttgtcttgagatttgatgaagtgttgaaagacttcgaggtagcacagaaagccttatttctaagttgatttcatgccctggtccttgttggttcctttgtataaagttaaaattgaactggtattttttgaaaatcataaaaaggcagcttaaagacaataactctaagcttttagggttgtttttgaaagattccgttttacagtgaaaaattgatatgtgttccccctccccttaaattctgctccagaagagcaaatagacatacacacacaaaagggagagaaacactagctaatctaaattgggaaatgaagagggctttttttaagcatgaaaatttcatcatcttgtcagctggcagaatgcctgctgtgtggattcacaaaggctaagaattacactttcatgaaattttcctcactaactgccctggttaatttgaaagataacccactgttctaattcattcctcaattgggcggtgcaggttttatctttgatctgacaaagcatttgtgttaatcgttttggccctccactagacactcttgggattgtgcttttacaataaatgtgtctgtgatagctctttagtctattatacttacaatagatccatagaactggtaattaattctccactgctttggaaatgggaagaataggtgtagctctgtcaagtgctgctgggaagtttgtttagctggttcatttttgaagtgttcccctcagccatccaagaagcagccacagaagagagtctgagattgagaagctggcctatcctgatgacttgctgataaatgggaaatgtgacccctcttggtacctgggaggaggatattgggtcatttacattcatctcaagtactgttctttttaaagtatattaaactctcattttaatacttaaagagccatttgcctctaacggtggagcctctagaagatgcaatcgtaatagtcaactcaaatacgttcctaaattttcactgatggcttatgcaggttttagagtattctgattgggtaaagtgtgttccccaccagccttctagtgtttctagccacttgtacattatatgagtactttactatgatttttaaacattgcgatattgctggccctagatggggctggccctccatctcaaagaacacatgaacagcttgttggtaccatgcatatgataacctctgatagttgctagggccagaaattggtggtctcactccatagaaagttgttgtaggctttataatctcaggattttcctgaattaagctttttgaggacaggggctgtgctttcttttctgttttatgtgtgatctctgccacagcccttgctctcagaagtacgtgtatcttgatgtttagtagccaaggaactgacaagtaaaggttatattttgctgttttttccttaaatttttttacattgctgtcagattggcggaagacttattagtggcctacaggattcttgggttaacacaaaattctacaatattttaaggtcatgaaagccatgacaaataaagctctttgttacttttctattttttacggcactgacaactctgcatttcagtatatgcctgtccccaactcaatagctttaatttgttttttccccaaaccaaataccaggcaaagaggcattaaccagaaatatcatcatgatgcacaatagcacctagcctaaatgtactttcattgtccagatagaagaatctatctctatataacgtggcaaagaaagtggatgcctagctttgttactctctttctgttctctccttgtatttttctcttttacttcttagtatattgtgtcataagccacattttaaaatctcttttggacccacatttatgaggaatttaaaaaataatgtgcagtgtatgtcgccttatgatgcaaaaacttccttatgcacacgtttaagcacttagggaagaagagagcatttgaccaatgatgctgagccttagcatggtagctgtgagttcttttggacgaggccacacaccaggaagtagagtaggatgttttgtagtgtatgaagattccatattaagcttgtttttcatctttgcaagttaaacaaaaaaactttaaaattttaaagtggatatgcattccttgaagacaaaattaataacaacccccaagcataatgttgttaagccagggattgaattagagctgccttttatcaaaagtgcaatgagggcagggtaaaatattggttaaaatatttgctccacaaaaatacccatttagcatcacaagtaagcacaattcatggctcccaacaatacttgaaaaagggtaattttgttaggaatgcacaaaactaaataaataaatctgataaattagagatgaagcagcctcccactctatccctcctgcccacacccatgtaaatcactaacagggcttctcatttccattgtctttcacttctcaacagagctatcttgtgcaggtggacctgtgagttttagagccatgcagtggcattcagtaactctactgtagtttcattgcaaatatgcagtgttcaataaccctcaaaatttctcatttcttacctgtggtgatgtggtttgatagtttttaggttataggttgcaatatgcagtagaatcacaggtatattagttcaaaaagtttaagcacttttggaattattgtttatttccttgcttctgcatttatatttagaacatttaaatagaataaatttggtttcttttttgtagactctaacagcataattataagtggtacaaaggcatacaaagaagcaatagatatccatcccacccattcaacatcacaggcagcccaatccatgctgcccagcagcgcttgaagaaggataatttttttaggaatccatagaactcatcctaaatcttgttaaaaccaaatgaaaagaacatattgaaaattagtatttattttcgcttcatagtatttgattgggaagccaaacataaatgaatgtcagggataccaactgcatttttaaaatgtgatattctttatgtttattccttttttattgttaatttttagagatagagtcttattctgtcacccagggtggtgtgcagtggtacgatcatggctcactgcagccttgaactccagcaatcctcctgcctcagcctcccaagtagccaggactacaggcacatactaccatgcccagctaattttttttttttttttttttcgagacggagtcttgctcttcgcccaggctggagtgcagtggtgcaatctcagctcactgcaagctctgcctcctgggttctcgccattctcctgcctcagcctcccgagtagctgggactacaggcacctgctaccaagcctggctaattttttgtatttttagtagagacggggtttcaccgtgttagccaggatggtctcaatctcctgacctcgtgattcgcctgcctcggcctcccaaagtgctgggattacagacgtgagccaccacacccggccagctaattttttattttaagttttgtatagacagggtctcactatgttgcccaggctggtcttgaacccctggcctccagcaatcctccctccttggcctcccaaagtgttgagattacaggcgtgagccaccatgcctggccttaaatgtggtattctaacaccagtgtccattcatggagggttggtatgtttttattcatgaatggctgatttttgttgttattgtcgttgttgtcaagcaagctcattttgagtcaggtataacattttgctgctatgccatggcatgttctcacagaaaaattaagaaacaagggactggtggtgattggaatagaatctcattgtaagtaatttatccttgtacaaatctaagtgaataacagatcaaatccaattccctaaaacatgccagctatgtattctatacaagcagcttatcatggtatatagtattaattgttgtaaaggagttctaataagcaaataagttcagatgcagccatttatgccacttgacttttatccttcgtagaataactaacatttacctgtattttctacatttatcagaagacccctttctcttttatttcatttaatcataatcttatgacatgaacccggtttggggaggctcagatctagagcatgattttgggggactaacatggaaccatcaccaaattctgaggtgctgaaactgcagagaatattgttgcctattgaggactaacccccagagccactgacgagatctgagcttgggccgtagtctctcccttacccatatcatttcccacatatggatatccaccctcctaagttttttgtcggggatggagaactatatgggataatgcacttaaggtgctgagaaagtgcctagagagagctcgttattaattatcactgttccaatctgagacatagtgaatgaacatggctcagctgtgttccttttgtgtgctcagaaacaccagagattcagacctgggccagggccgtgatgcccaggtcttttcaaggtatctccaaggtattcatctggaagcttttgtcttatgctctccctctcacatccatttagaaggataccaaactgtgctgtgtttcctcttggccctcccttcagtttgccagtaaagtagtttccttttcagtgttggtgaatagagtctcaaagtcagcattgggaaatggatactaagctataactccttcaaggcaatagcacagaatactgcagaatactacagcacagaatattacaatagcacagaatactgcagcacccagtattgtgcctaacgtgataggtgctcggtaaattttattgaatgagttcacgatgtcctgagaggttggtgctatcaagtgactctcccaggtcacacatagtagcatcaagactgtgaccatacttggagaccctagtccggtatcctgcccataataacttggaagacagccagttatggataccaagttgcttagcatcttctttgcagtcactcttagagcaggattgatcaagagccttcgctattcgcattacaagctaggccaggtcacaaggctgactggggcatgagtccagaaggctgatgatagccatccagcaatggactagtacagccattgaaaggaagcacgtgttgaacctggggtttcagcgacttctgttatggtttgcctcctctgacgggaaaattgaaagctttctgaaatgctgaggaaatgccataggagttgtcagatatctgaaaacaagtgggtaaaaacagaaaactacttgtgccaaaacagtagaattcctttcttcagtttgatttctctaacctggtgtatttaggaaaaactcaacttcaggtctaactccagtcatctagagctactgtcttgtagtagagtaagaaattgaaccagaacagatttcatttaacctttcaaaagtgagattttcacacagttgaccttcttgacttcaaggaacaaaacgggactatcagttctctgctgcatgcgtcaacaagagatgggaggagagcgccccaggcgatggctgtttttcatatttggtttgcccagagaatgtacattttggttcacatatggaaatcagccctttgtagatagttacagataggaatttccagatgatcctgtctaccttagtcttgtcttaatggaataaccatatttctgtttaggagtgggttaattcagctgcctttccaaggtaccatggaaaaattctctaagcctggattccaagaaatactactattgatgagaattagagcactggtgtttttcaaatggtgggtgttggtttgttttgagcttggcataaatcacgtgttgaccttagcttgcttttttttttttctttgagacagagtttcgctcttgttgcccaggctggagtgcaatggcatgatctcggctcactgtaacttctgcctcccgggttcaagcgattctcctgtctcagcctcccaagtagctaggattacaggcgcgtgccaccaccctcagctaattttgtatttttagtagagatagggtttctccatgttggtcaggctgatctcgaactcccgacctcaggtgatccacctgccttgaactcccaaagtgctgggattacaggcgtgagccaccatgcctggctgacctcagcttgcttttgaaaaccagtgtataactttttgtcttggttcaaaactcatctgactcttgacacttcttccaagtttttgttttcgtttttactgtgctatagtgtaactctcagggtgggtagttttgtgaggtccatcacccagcttgtttcccggaagatccttggcctcattcagaccattcaagtgctcatggtttcttggctgtttgaggagctcttgatgtttctgggaacctagatgatttgccagcccagctctcaggagcccagcctagcagggcttccgtctccatccaccatcaaagaatgttcaagaatcttggcatcaagtggcaagaaaaaaagaaaactacccaggatttacatctatatgtatactaacgatttataaatcatgtggataaagttatggctaatcttttgaggatgatttctctcaactacagctttccctcaagagccacttcttccagaaattgatcagcaaagaaagatcaaaggaaagcccagattcaagagagacctctttaaaattttccagcaaaatagattctcttactgacgaatgtatgcaagtggtatagcacagtggttctcaaaccttttggtttgtgggacctctgtatactcttaaagtactgaggaaaatgaagagttttagtttatgtggatattctttttttgtcactacaccaaatctggtaatgatatggtttcttaaaggttatttacaatgtggaatctgaaatcatatcggtaaactttttgtgctctggtatattaaaatccattgctctgtcttgcactttgagcagatcatttacccatgcatgattttgtaacatcatgccttggtcacttagaaaatactggttcactgacatgaagaatttccaattcattatatagttttttgaaatcgcatttgttcatatcatcaccagtctcatcagaaaagtctaaatattgggaagctgttgagctcatcgtggtggatacaaatgttccagtgaaaactaattgaaagctagaaatttgtcgttggttacaaatactgtcagttggtttttcttgaggttacaggatcagttggttaatttttgagaagatgtctgccagatacccaggtctggataaccatagttatctatccgttattctttcaagtaaagatggtattatttgaacagagtggttagttcagcttgcagctcagacagttacacaggtgcttttcctggaaacaaatactgtacttcaacacatgataataaaaggatatatatttaaaggttgcaatttaataaaattttactttcattgaggactttctttagtgaaactggcttaattttctatttgttagatcctgagcatgtgatgatgagaaatacaatgatgaatagtacagtttggggccactatgttgttgttgttgttttgagacggagtctcactctgtcccccaggctggagtgcagtggcgcgatcttggctcactgcaacctctgcctcctgggttcaagtgattctcctgcctcagcctcctgagtacctgggattataggtgcccaccaccacgctcggctaatttttgtatttttagtagagacagggtttcaccatgttggccaggctggtcttgaactcctgacccaggtgattcacccccctcgcctcaacctcccaaagtgctgggattataggtgtgagccaccgcgcccggccacggggggccactactttgattgatgctaatgtgccaggagttttacccatcattgactttgcaccattaatgcaaatgtcaacacagtgaaaaaacaccaataatatcatcgtaatattataaaaaatgttttgactttatggactccagaaccttcacctttgactgtagcaatttatcctaaagaaatgtaccccaggccgggtgtggtggctcacgcctgtaagcctagcactttgggaggctgagcaggcggatcacctcacgtcaggggttgaagaccagtgtggccaacatggcgaaacctgtctctactaaaaatataaaaattagcctggcgtcttcgcacatgcctgtaatcctagctacttgggaggctgaggcaggaaaatcgcttggacccaggaggcagaggttgcaatgagctgagattgtgccactgcagtccatcctgggcgacagagtgggactccatctcaaaaaaaaaaaaagcccaaaatttatgtgcaagaatatacattgatgaattattctttttggtagtaaaaaaaattggatatatctaagaataaatgtttattaaatacattatgctatatcaatggaaaagtatatgatctgagcaattgtagcaacattttgtgagaataaagacacaggaaaatgtgagataaatgttaacgggggagaaaaggaggaaacagattagtatataaggaatgattcagttatgtgataaagatactatgtacatatagacaagtgtaaataaataattggaaagataaatacaagaatgttaatagtgatcatcttgagtggtagggatatgggtgttttaatttgtgtctttatatttctgttagtctaagtgttgtacaataagcatgtgttacttttggggggaggggtgttgtttgcattttgcaaatttatttttaaatttatattcagtacaattcactctggtttacagttctgtgagtgttgacaaatgcatagaatcatatatctactaccacagtcaagatacagaacagggtcatactttctggcatgatcttccatctgcgacccaccatactgaatatgctgccaatcccaaagatgcacagaatgaaactttgtaaggtgtgtgtttctttgcttggcaaggagtgggtaggtacatgatctgtgaatataaaatgaaatttgaaggacaattcccccaaaggacattggaggaaaattctaacatttccattggagcttcgtcacaagaaaatttcagctctgaggatttgggaaagaaaactaaatcatatcttcaattcatttcgtccttccagtgggtcatgaagacagagaacttcaacgccatgatcagtggttccaacagtcaagtagtcatccctacgtatactaggggtggggggcagtgttccatgtataccaaaacccgtgcatactgaagtcccacacttgaccccgcagaatcctcggataggaaaagccagctcaccatatgtgtgggtttcatgtggtttggtctaaaacaatccatgtataagttgacccacacagttcaaacttgtgttcttcaaggatcagctgtatatttactactatcgctttctagaaattaaacctagatattaagccatgtaaaaagataactttcctatattcaaatatgcatccattttaacctactcaagtctatagctgagtttgttcttttacaaatttgagcatgtatatagattcatacattcaccaccacaatcaagatagaaaacagttcctacaaaaaccctaaaaactcccaaaatagtcctataaaactccctcctgctattcctttataagcacaccctccttcccactcctaactctgtcaactatgatatgttctcatcagtagaaatttgtcttttcgagaatgtcatataaatagactcatacagcctttgagactatcttctttcccttggttcattccttttattgctgaatgtattctatcatatggatctgtcagtttgtttgatccatttactcactgaaggatgtttggattgtttccagtctggggaaattatgagttcaggtgctataaacattcacgtacaggtattttgtcagtgcgtaagttttcatttctctaggataaatatccaggggtagggttgctggctcatatgctaagtgtatgtttcaccatttaagacattgccaaactatttttcagaatggcagtatttttttcattcccgtcagcagcgtatgagagttccatttactgggcgtgctcactggcacttgatattgttggtattttttattttagacattttaatatgtatggaatggtagctcatcatgatactaatttacatttccctaatgactaatgatgttgaacatcttttcatctgcttatttgtcatccttatatccactttggtgaagtgtcccaagttttcccccatttaaaaaaaattggattttttttttttattgctaagttttgaaagttctttatatatcctagatacagatcctttgttggatatgtgatttgcaaatatgttgtcccagtctgtagcttgtcttttcattctcttgatagtgtctttcacagagaaaaagttctaatttttatcaagtccagtatatcaatatttttcttttattgattgtgcttttgatctcatgactaagaactcaaatattatctatgtctatgatccattttgaattaatttttataaagttagggcagagttcaatttttttctttggtctgtgtgtgtccagttgttccaacaccatttgctgaaaagtctgtccttcttccactgaattgcttttgcacccgtgttaaaaaccatttgagcatatttgtgtgggtctatttctggactctttgatctcttccattgatctctctgtttattcttttgccaataccacacaccttgattactgtagctttatagtaagtcttgtatagtgcaattcttccattttatttttttcaaaaatgtcttaattctagtttgtttgcctttccatataaattttagagtcagcttgtccttattaacaaaatttttattggaattgtgttaaatccgtatcaattggggaacaattgacatctttattatgtcaagtcttccaatatatgaacactttatgtctcatttatttggatcttctttgttttcttccattaacattttatagttttcagcttatgggtcctgtacatgttttgttagatttatatacctaaggagtaccttttggttctcaaaagagtactgaggatccatgaaatgttaaaaatattctacataaatgcattgttaatatgtagcctttaaattttattttgtaaacctttattgattagttcaaatattcagccacataatactgccaagtttttaaaataccagcttttgtattgtaattttacttttgtaaaattcttagatttacataaatatctgtatgtgtatatacgcctagagagatttctaaaaggatttttaagggtttgaaaaccctttaaaaatacatgttaatgaattctaatgtaccactgaatagttaacatgtaattaccatgtgctatatatgagaatatgaaagtaaaaggtatatatactttcacgcctgtatcaagttgattgtgtacttataaataagaagggagttaaatttctaaaacacaaaaatgagttctcatgtgacccaaaataatttttggaaagcaaaaataaccattgtatcttcttcgtatttatacatttttagtgggaatttaccatgcttcttaagtcttcagatttattgctgactcttgacaaatagtggatcattagcattgctcaacctcgcctcttctctgttgtgaatatgattgtataaacctaggtgaggagtagtgtgcatagaaatgtcatctttcctgtatctcttctaggggacctgcctaatgatttcatgacatcatctgatccagtatgctgaggaattatggtctttccaagcttttaaagtagttttgagaccttcagttctgtcactaccctctcgaccttgactgtgactcaccatagtctcttttggactagcttcagctttccatctataggaagtgcctagttttttgcacagcctagcactccatgagcagggcctgaaagtcaaaatggagcaatccctaggctgcatttctcaatattccttgtaggaatcagataacagaaatgggattctgcaacttcttcagcatataggaacttgagtgaaaatacaggactgcccatcttttgaaatgttttggccttcttcacagttcctgtgggaactttgaaaatttttcaaacttgttttacttagctacctgtctacacaagcatgtcagtactgaagtaggctgtctgaaccctcctccctaaacaccattttccctgctctcacacaccaaaagtatttaaagtgccttcaaaaagtgattttaaaagaggattccattattgttaatatacattgtattttgcacagtaccttgcagttttcaaagcattttttatactgtacctagtttgtccctcacagtattcctgtgaggtattcagagcaataccctccagtatttcccagcccaggatgaccaaagcccacaagtttccacattggatatcgtggtgttgtattatattccacttacattgccttttcttccattctcactgctttaattcaattcctggtcatctcgttcttagcttgctaatcgatctcccttgtctttgtatcagtccattctctatatcatttccaggattatttttccaaaacaggattaatgtcatcttccaggttaaaaacctcctgtggttgttcatttcttaccgattaaaattcagatttgggagcactgcattaggccccaagccagcctttccaccttctctaccctcagtatcccttgcagaccatctgcctgccgcactggagagcttggcattcctcagggatcccttatgcttgactatctccacactttcactcctgccatttcctctgcgtagtaccatagcccaccacttgtgacatcccactttgtgaaattcttctgccttcagtggtacagtctctggaaagccttcttcactcagctgtccaggcaaaatgtcttactgttttctgcatgctctcataaccttttgtacacacctctgtggcagcacctactgccaagttgattggctctttttccctcacaggccttgagctccttgtgaacacaagctgtgctgtgttgtgttgcgtttagcttcatgtcacctgagcaaagcatagtgccagggacatggctgacacaggatttgcttatttgagcaagggagtgatttttggaaccttcagaaaagctgtgggtgtagtatttatgtttgatggaatacccaattcttactttttattgttaatgacttcacagccagtggatggcattttctaaaatgtcatctttaatctcttgctgtctaaacttcaatcaccttaggaatctctaagaaattaaacttagtcttgcatcatacacatacacatattttgcaggttttcaccttaaaattattttctgtgtttctagcttgttcttgaaccacaggtgtggtattgatcttttcttttacttaatagcacctttcctgccctcacgaccatgaccaggaaactggcttcttagcaccaaggctgattttcaaattcttgttggtttaggttctcttaaaactagtcagtcatatctttttcctattaacaccataattaaatacccagagtacagttttgagaagcccttagcaccatgtgtatatacatgtgtatttgtctggttttacatgctcttttcctagccctagcatgcacaagtgcactcttgcacaagaatgacagagcctagttggcttttgcctccttttggagagctgttatatttattggtcatatgcccagtggacttccttcctgttccatacttgactggtagttatggagcacctaattgtctgacagaagaagatagttcagcagagaaggctcattatagaattgtatggccttgatttcagggaacctgtcccctttgtctaccttcagaatggctatttcccatttttggaagataacttgagtatgtggtacagaattaagtattttcagataatagtaatgcagtatttcatttctgttctggggttgctagtagaagcaactctgtaggaataagctagagcaaaggagtgaacatgagtttagatggcttttctttttgtcagaccatcactagccattgatagaagagctgtacttttgtgttactttccttttgtctttaacagatagagtgaaatataatttgcaacacttggaaccttgtaaaagacaaccaaccaaacagataacaaaccaaaaagaaatcacctaagtcacacactggataaagctttctctgagcagcctctgactccttggacagcagtccctcccctttcagaatcctaacaccctgtccccaccaccactctctcagtgttctgttgagggcaagagtcagacacctagcttttgtgtttggctttaaaatcaaagttgttttatcatgttaaactgccaggaccatgtcttcttgatgtaaaacccctgaaacatctattacaatgccatagactcagcagatactcagttgttgtatttttttatttttgttttgttttgtctttttttgagacagggtttccactccctttgcccagactggagtgcaatggtgtgatctcagctcactgtaacttctgcctccccagctcaagcgattctcccgcctgagccccccaagtagctggggctacaggcaggtgccaccatacccagctaatttttgtatttttgtagagatgggctttcgccatgtttcccaagctgatcttgaactcctgggctctagtgatctgcctgcctcagcttcccaaagtgctgggattacaggtgtgagccaccacacccagccaacactcagttttatgtgaagtcacactctctagaaggatctgaattccatttctgtatttataagcatgtagattataggaacaactcattttctaaactaatgctttacctggttctctggtaatcttttttgtgattggaggccatcatcacagaagttagatatccatcacgatgtttgtcttatgagaagaaaagatgggctatttggaagaaacaaattaggttttggtaatactaagagaatcagttgtatatttcagaaatttagggaacctttttatttgttgaatttataagtaagacatgcatgatgtctaaccgttacctaaccagagaatttacttcaagccaaattttgaactgcataaatgttaacgtttatgaaaacgggttctaagcaattctttttcagttgtggtgctaaatgtctgtagtaaaaagtatataaatatatacttgcatctttatgtatatttctttaaaaatttgttttatgatctaaggtttaaaaaatttgataatgctggctatatgcacacttttttttaagtcaggaatcgttccttttcttctaaagtagacaatcaaaataagcagtttgaagagattgatttaagacagcaaaattgttgtatcttcagctgtgtaaaagaaatactgcaccttggaccagaaaatgtatattagtgatggtttggttagtgactgcaaaagcaaaataaataccatagtataaaatacagtttcacctgacagcatgtttgactagtactaaacatctgcatttagggagcagttagtactaaaatgtgttctgcttctttgcatgaaaatacattaatttgaaatcttacagtgcctttctcactgattaatattaggaagaggtctggtcaggtcttgttgataatttgttttctagaaacgtggggaaaaagcatttttcacaaacctatccaaaaaaagttgccttatttctcctccttaagcctttcaatgactttgcagaataaggttgcatcattgtttattttggatgtggaaggttgatcagaacattgctttttactgtaaaacggcagtgtaatgacttaaataataaacttacaggcacagggagattttcttccctgtgttagttaatctttaaacaatctctagcattaagaaaaaagatactgttgaagaccccagattgcaaaagcagtgccacttcttttgagagctttggggcaatcctctgatgtgtaattgctttacatcagtcacaagagagagacaagaatgtgctttccttgaacttaacagtttgggcaattttctataatccagtaaatacaaattgtagcttgattattcatctacgtctgtcaagcaaattttaatggatgaatgaatgagtcaaatctatgcatggaaatatacaaatgtgcaaaatatgggtctaattaccaggctgctgaatttacacaaggtcaggtaaacaaggcaccagtgtaatgattattaattgttaataatgcctttgggaaaacattcacattttccttctgaatacctaacagtttgcctttctagtcattttaaactctgaaaattttagctggtctaaaaaaacaaaaacatttttgtcctacttttatcctttctctataattgcttactaatttttttagaataaaggtaaaatgtaatacatttttgaggaccctgttgaaaatcatagtttaatatgatggtgaaagaattaaggggggtagcatactcacagaacagaatgaaatagctgctatcttttgtcttcattgaagggaagagtatgcccccccccatcttccaccctcttttcaaacctaatcgacattctacaacacaaaaccaaggtggtaataaaggaaaggaaatcaaagcaggcttttttcccctctatttaccatagtaagtcaacatttgactctgtcttgatattctataaaatgaatgttggaaaaagaataatatcaatgagtagtttcccatcgaaatgcccaagggccgaaataattgagggaatacttgccaaggtttttcttagttcagtaactcttgatcactgtgcagttgtgtagctgtgctatcattaagggctctccatgtctggaaggacacccccctctcccagctttaatccaaaagtcataaattgtagaactaacatgtcgtctacgggtcacccaggcgaaaacactgcatcttgagaaatctatctttgtgccactgtgctttgaaaatcttttgaatattttgcattaatggtgctcccgcagtctcttgctgggctctctcctcatcttcacaagctccatattgagaagtttttcctcatagttaatctaaacattcttctctctgttctaggcctcacttcttactacatacctatgttcagtgttacatgagtatacccaccttcctttatggttttttcccaagtatttttaagtagcactcatatctccctttcattttcgtttttctggaactatttatttatttatttatttatttatttatttatttatttgagatggagtctcgctctgtcacccaagctggagtgaagtggcacaatctcggctcactgcaacctctacttcccgggttcaagtgattctcctgcctcagtctcgcgagcagctgggattacaggcgcctaccaccacgcctggctaatttttgtgtttttagtagagatggggttttgccatgttggccaggctggtcttgagctcctgacctcaggtgatccgcccgcctcggcctcccaaagtactaggattacaggcgtgagccaccgcacctggctggaactctttatttttaatcgtgattgctctttgtgggttagattatagtgtatgtaagccaaatgaatttgagcaaattttttaccttaactctgtagttagcatcctatcctattttgtataccactctagaatataacgtacactttatacatatttgtgagtgctatagtggtttaattaaatttatgtagcattatagccaaactctttattctggcatttgagacattataaatccaaccttccctttccacagactctatcatccagcaacactgtcaaattatcattcctctagacagacctccttgttttcacacaactgctgggattgtcgtcacccacttgccatttttatctttttcaattctccttcacctttaagacctaaacccatctcacttctaggaagcctttcgtggacatcacagctatggaatgtttttttttttttcctctgaatccctaaagaactttaaaagtataacttttctccccccattttctttaatatagtctcttatagtcgttcttttatttggcaaatcattttgttccctataaggttgtagacttctggagaacaggggaaagaagaaagactaatatttttttagctgccaaacacttgctaaatattttttacgtatgtacgtttttaaatggtatcatttaattcttgcagcaaccctgtgaggtgggtggtattttttccatttttacaggtaaggaagctgaatcttgtagtaaacacaaccaatgttagaatggtaataatacattgtagagctgagatttaagtttgggcctctctgatttaaagcctatatgctcttttcagaaagcctcctccataaaagagtggcaatttgcttcctaatctgccaatttactagaaagttcaaaaaacagaataggtgttcagtaaatgattaaatttatgactgtggaaatctgaattgctttgacttcatttcttttacctatcagctagtggtaatatgaatcagcaataaaatagccaaagccttagtaagggccctttgtattctcaccaaaggctagtagtacatgaaaggttgacagttgtactccaacattaaggctgtttacttgagacaagttttttttacttgtttgtctgtttttaagcttttctcttgttgattccaacattcactgatattgctaaatgtctcttttctcacttagtatttgtatttcattttaagagagtaaatttcattatataatagtagcatgaataatttatgcctctgtcaaggaactattaaaacacagagatttttaaatatgcatattctaaacttcatataaaaactacggaatggagtttttatttcctctctgagtgtttattcaggagtaaacctgggcacttactaaaaagctatggtcttactgacttcaatttaggatagaatgctgagttgtaattatgtctatagataaggagaaattggtgttttatctttagtagaaaatcagctgatgtactttttgggggctttttacattttttatttaaaacaggagtttttatgaggtgtatttattctcaaagaattaatgattataaggattaagaaggatgattgccaacctaagaatgaaaagaactttgatttgatgagcacaagcaatgtgactgagctttggggtgacaaaaatacgatgttttaggtatctggggtttcttcttatcaacttccacgcatattgataagttcagcctattttgtaaacagttactaatgccataatgcattttcccatattttccatctgaatttttactattattgattgaagattcaattgagaaatgtgtttagaaccctgctttccgtggtaatcacaggagtcagtgggaagacaagaaaattgtattgaaagaaattgtgtgcgtgtgtgttttgtgtttcagcatagattatctctgccaaaataatagctgtcattttgtttttgttatattagtggcccgtagcttaccactactccttttgccttagttttgcttctgaccgctggctattcccatcagcaagaagacctttttaattgaatgtccaaatttgaatgattcttgtcctaatatcattataatcttgatccatttcaaattagagatccctaaggttgacttctcacctcagttcaacaatcctttaacattcagagactttgaaacttcacttctgtttagaatttcatatcatgcccatcatggggggaaaagatggaaaatgtatatgctgagcctataggacctcctgcagtgcttattaatcctttgtggatcatttgaaatgtttctagtttatttaagctttgctgcttgtatcagattgttcctacgaaaaaagaaaaagtgatcatgctttgaatttttaaaaatgatctcactttcaagcaaaagcacttttatgctccattaaagttgaatttgccaaactcttatgtcgcattaacacaagctttactggatagataaatgtgttgttcaaagaccaacttgaactttaccaaactgcttattaagatttttatctttattcttcttatttcttaaattattttaaaataaactagtaaaatagactagataggcctaaaagtactactttaatgacaaagtaatttcttcatttgaggtaaaaaaaattagtatagatcgtaagctaattgtttatgaaggcaaaattaacgaaaatattttgatcacttttatatttttatatttgttttatatagtatcaatatcacaataaaacttgatttttttttaatttgcataagtgatttattgttttgacatttataatttttgttctagtctatcatgcatctttgaaaattcaatattttcttgaaatgtttagtaggtcagccaataaattgacttttttttatccttctcaatttagtgggttttttcaatatgtgtaggacatcttctgttttctatgaatgatagtgttatattctttgtttctatttattttgtgacgattttagcttggaaataatcttggaatgtgtatctttttgacctagagttactcggaaagttctagtctcatttgtactatgttttctggctccctaatacaattataaggacttagtcttttcatttttagtctccttagccttgaggatttaatttaatgtgtttgttcttcagaaagaatgtaagctagttttctacttgaaacgtctttttgtatttttaaatacatgaaacctttacagaggatttgttttatcaaaaaataacttacatgctcttttttaaagcattaatttacatcaatatttatagtgaacttgaaaaaatattttaatggtaatgaaaatataatttaatatcaagctaaatctttttcagccctcttagattccccatttttagctgttgagtcactggagttcctaataaagaaaaatgcgtttttaggaaattacttttctaaggcaaacaataaattgtacacacagagggaaaggaaaggagaacttttcacctgcctcgtgtagggaaaaatctaaacaattacatgaaacacttagcaagttattttaatattacagcttttccatttctgagaatgatgataccttgttagtaagaaactttattaacactgacttctagtgtaaaaatctgccctggattcatttttcactaattcactctattattttctcctagtgttcccatgacctttcagaaatgtgtagttcgtattttgtgctgtacgaaagctgccccttaggttgcattgagtaatgcaaagttgaattatgaacataatggcagttctctgtggcatttccagttcatgcttacttttagtttgctaaattcataagtgaaatgttttttaatgttgtccacgttaggggaaaggttaaataatgctgagcttttcttcgtgagcaaacgggaagagtcattttggttgtttggtagaagattgtgttcccatattttcattctttggccagcatagatggtgcactggattgttttggagctttcagacaggacttacatacatctaaaatatttcataaactgctcgggtagccagagtattcttgtatcactgtgcaatagcactaaaaatcatcctgggataagaaatgtgaagcataacattacttcccaaagtcatgtactttgagaagccttgagaagaggcaagagagtaacagtatctatgaattctctgaaaactcttgtttccagtaggaagcctggttacccaccaaaaagtaggtgatgagaattttttttaacttcaagcataatctttctaaaaatgtaattttacttgagatttgcctctcattaaccaacaaaccatatattttggtcacatatttaatgaatgcgatcatcattgagttgtttgctgtgaagggacatagagaagatgcactgttttccatttttccaagtaatatgggtcacatcataacctgtaagtaatccatcactaggcagtggctccacagcattcggataaaaatgttttaaacattcctgaaagaagaaaagcccacaaatactgccctgtatattgctgggagagaagatatgagtgcttgtatgtgggaattattcttttgtctttttaaggcaggtctcactctgtcacccaggctggagtgcagtggtgtgaacacagctcactgcagccttgacctcctggtcaagcgaacctcccaactccgcctctcaagtagctgggactacaggcgtgtgccaccatgcccagctaatttttaaattttttatagagacagggtctcaccatgttgcccaggctggtgtcaaaactctgagctcaagcgatcctcccgccttggcctcccaaagtgctgggattacaggcatgagccactctgcctggccaggaattactcttgatcacacaagtcttttatggcagtttgggacactggtcttacatgttgctcacagtgtcatcccatgaaagaggcagggtaggtacacttgcagtatccatgggaacacacccaaaggctgatagggtgaacggcttgcccaaggcacatggctcctgaagcagtgaggtgagaagagatctttgagttggctcctgcccttccattttgccacagggcttctttatctacctcctgcaaggagggcacagtgaaggaaggttcggatgggtttttggactctcacaggcagcctagcctgagggaggctagagtgttcagccatctgaattaatctcgatatcagagagtttagttccctcagtgtaaaattaaaagaatatttcttcatctgctgcaatgcatcagacactatcctagactatagaggctcaaagttgaatgatagcatctcagagctcttgggggctgaggtggtggccttctgtctccctttcttctacctctttccttctttcctccatccacaaactttttgtcctcttatatattagcacgtttggacctcttcctgcacttaaagtcatgcctaccttcatgcgctccaggtgtcccaggtaaaaagagccattccccaagcgatgctgttgaaactgttttaatatagacccagcatgttgcttgcccttagcattcattttaattatttgaagaaagtgattcatacaaatatgtacaaagtacagcccttttgaaggtttttcactttaacagtgactttacatattattttgatagtgatgttcctggtatgggcagcgaggatgtaagctgggccagaagaaggatgaatcctctctgcttagggaatcagtttgctggacatgtgaatagctatatccccactccagataactgtacccacatagtgttatgatcttcaatgttttagtgacattgtaaatgtagcaatagagtagagagtcttcatcatttcatactggtatgtaaaatgccccaggtatgtgaccacttgaagcacccggcttttgtatgctcagtaaccttgtgtacagttggtgaccagttagcgcaatatcttagtccttcactcatccccaaggaattcaaaaaattcatcctgttacgagtggctttctttccttgacaatagtttgaagtccagcatgtaaaaatgtaaatctctctgctggcttctaatgtgcaaggccttctgagagtgttcccagggaagaagagttgattaggtagagacttctctgttcttagtaaattaatgacctactccaggcccattttcttctttcctggaggaacactcagtgacagtgcttatgcagccatgtcaaattctttagttttattatataaaacatcaaacgaggagccaaagagaatcttttcctaacagcatctcctaagccctagaatggaatcagaagtaaggcaatggactagcaaatggacaggcattcctaaaatcatcttagtgtcgatgggaggcatgttaggcttgccacagatgagtgagacatgaaagtagattcaggggcttgttagaagattcagagctaggtcaagagagctctggagatgaatctaaagaacttttctttgaacctgtttcaataacacatgaaaacatctcctaagatggcagatcttttccttacggttcttgcaatttagaaattgtaggccctgggaatgtgtattaaaatccgtagcaaccaaagtattcagaggggaataaggtattttgggctttgagaggggcagcataatgggcagatgtcaggattaacaactaatgattgatacatatatatattttaagccttttatctgtcattgtagcactctgcctcaacctggcttctatatgtttcacaacttgatagaatatgccatttagtctcatgatttatacttattaaaccttatttgtataaatacatgcccatttatcactgtcacaccagtgaggacctgctcaaacacagattgctgggtgccacccttagagtgtctgattcttggtctggggtaaagaccagagaatgtgcatctctaacaagttcccaaatgatgctgatgttgctgatctcaggcccacattttgagagccactgctgtagacattcaccgacatatattactcagccgggagcacttgaatgaaaacagtagtaacactaaatcctaacttaatggtggagtaatgagatttagttaagaggaaatactttcagtgctaggaatgtgtatattttgctaacctcagttatggataaatcatgaaggcttatggggaaccttatttttttttttttaaattatgttgtagaattagagaattctcacacttgaacagaccttacagtcatctatcctgatgcaacacccatctttatgaaagaagggactgaggcccttaaaattcagctctgccccatttcaagttgtggtttttagaggcagagccaggagaaatgattgaatactatagtttaatttaaataagacttatgttagggaagggatcttttaagaggactaatttcccaaatataaaaggagctattttaatatttagtcaaccattcaatgtcctttagctaaagtttcagtcccaaagttgattttaggcactgtgagacaaaggtctctacagaatctgtaatgattttaataaagttacttttcttcagttgcagagattcctgggtggcttagttcttaggtccatggacttagatccttgggaaatctgctagaggcagcccggtggaaatgttgataaatatcacattttgaaaatattaaccgttgtaattagaccaaaaaaaggaatatataaaaattggaagaagggggaaattattatttacagatcattctaacatggaaaatccaatgaaatcaaccaagaaactatcacagacaaaaaattttaataaggttactagttataaaatcagtgctaaaaatcagtagctttcagctgtatacacacaaccgattagaaaacataatgaactctcatttataaatgagattataaatctcatttataatacaggttaaaaagaggaaatacctaggaataaacttaacaagaaatgtgctagatatatttgaactctgaatggcttaaaagaagacttgggtaaatggcaaagcatatattcttggctaggaccactcaacattttaggattgtcagttcccctaagtttatccataaatttaaagcttcctcaatttttaaaagaaaatcgcaggaaaattctaacagagaaaatgacccaccagtcctaccggtttttacaattaggatatttaaaatattttggtgcaaaaatatttggtgatttcagtggagcaactatagaaagcccataaatagacccaaagttgcattttgttttttaaaagggggtagttcacgtcagtaggaataatcatctggaaaaaaatacagttgatttcttccttgttccttacactgaaacaactttcagaaggatcaaaaacttaaacttagaaaatggaactataaaagtaatgttgttaataattgtggaattgagaagactttttaaataattgagtttattttttagagcagttttaggtcacagcacaatttcagagtaaggtacagagatttcccatatactccctgccccacacacgtatagtctctctcattatcaacatcccctgccatagtatgtttgttacaactgatgaacctatattgatacatcatcacccagagtccatagtttatgttgaggttcattcttggtgctgtgcattttataagtttggacaaatgtttctaacatacctccaccatcacagtatcctacagagtgctttcactgccctaaaaatcctctgtgctccacttattttggaagacttttaggtaatatatagcctaggaaagggtatagggaatggagcactctcatacactgttggtgggcatgaaaaatggtacaccttttggacaacaatttggcaacatcatcaagattgtaaatgaacataccgttctactttgcaattctaatttgggtatctctccttacacatgtacagtccttacagatattatcaaaggtactatacaaggatattgcttgcagcgttataatagtaatagtaagagactgaagacaacctgttgttgatcaggagagaattccttagattattactatcatataatagaattttgtgcaaccgttaacaagaacactgcagatctatatgtactgacaggacataatttcctccacttttcagtgaaaaaagcaggatttagaacagtgtatatgataaactttcatttgtattttttaaaaaattagagatattcataatatgataatacattttaattaacctgtttgggtgtggtggctcaaacctgtaatcccagcactctgtgaggctgaggcaggaggattgcctgggcaatatagtgaaaccctgtctgtattaataatatttaaaatttaaaaaattttaaattaacccaatatatccaaaatggcattttattctgtaatgagtgttaaaaataccactaaactattttatagtctccttttttgaactaagtctttgaaatttgctgtatattttacacttgcagcccatctcaatttggtctagccatatttcaagtgctcaacagccacatacagcgactggctcatatattaagtagcatagatgtagtatgtaaaaagcactggactagaagttcagtctacatgctgtgtgacagtgtgcaaaaaacgtactttcttctgggtctcattttcctcacatacaacacaaaagattagacaagagctctaaagtctcttccaattttaaaatttagggtttaaatatatcatttcttattacttgtcaaagtcaagggtgtaattgtggttgctttccatagacactgttttcaccagcactcctaaaattctgtgattctaagtaaagcacatattttaagaactatattttattgtcagattgaggttgtttatttgtttaaaggaagaatgttattaagctatgtacatgatgtaaaccatttagttcttgtaatacaattaagtcagatttgaggctttgataattctagtgctgcatggaaaacttggaagagcaagagtgaaccaccaaaataatatctaaagaaagagtaaatgtagaaagagaaaaagagttgagagataattttttaagtacaattctgtttatgaagttcattgttcagaaaataatcaccggtagttctttttgaacaagagagagaatgagaataataaggttctcaaccttagctgcacattagaatcacttgggggaacttcttaacatcccaaagctcatttcgtatcccaggctgatgttctccaactgaggtcccaaaccagcagcggcagtatcacctgggaacttgttagagatgcaaattctcaggccccacccaggacctactgaatcagacactctgggggtggcgctgtgttgtaacgctgccctggtgattccagtgtgccaccagagttaagaattctggagcaagaagtatttggaacagggttaacagatgggttttatattgagtgccagcttccatcctatagtggtcttgaggacagagttggaaacggaactgcaatatacctgctaagtgtttgccattcctgatttagtgatttgggtaatttattaacattatagaaggttggatgttgcaatcactcgtagatgagcctttctaaacaaatatatgtcaagcatctcagccagttggcaaagaaaaaaggcgaaaagggaggaaaagcaggagaaaagaaaaaaatcacattggaacagaagccacaaaagaaggggggaggaatatacaaggtaaaatgttataagtgaagaaattccaggtagattataaaatatttatatgtaagggtttcttgagttcaagtgtgatggggattttaggcccatttcaagatctatcatcaattctatctgatcaaaaagtaccaaaggcttgttcagccctttaatttggcattaagggttatatttcttcttaacattcagacttttgataggaatgcacttaatacaggtatggtaaatttggagtgaactaagccagaaaataaaatatattttcaaagtgtaaagaagttatcactgactgagaaggagttaatgtgtcatatatccttttgatttctactctttgagagaaatcacagtatctataatttcggaggcatattcggaagaatgttaaattgtgatttctctatgctgaatcttagagatctgtcagggagtcttcagccctgacaaaataagaatggacccattatagtatcaggtccatttgatttttcaaaagttaagggaaatatgcagatcgtttcagagacttctctttttgctcttgcttgttataagacagatgaagggaagcaaactgggctgtgtttagaatgcatctggagctgcttctctctcgagatctcggcagtataacttctgcaagccctttctgtgtgtatttttcttttctcatcctgaaatattccatcttgcatgagaaagtcagctttgataatttccaaaagctaagtattatgacagaatttgtgcctcttagaaaaaaactgctcctttactataaaatagaacctaccttttatacctgagtaaaaaattctgataaaacttttctaatcgtatttattattgaaaagattatttttgaggtggtgtttactaaaatatgttgatttttatattaatttctgaatactcagtttatatttttagattgttttgtgaattgggatctctgagtataaagtggttttcagcacattggtgatattgaacatcttcctcaaatagcaagcatatgcatttcaacagctttcgggacagtactacagttaataatttctttacaagacaaatgtatgcttttttattgttagcattattttctcatcttatgttctggcatttaaattatgaaacttcatctcggcatgtagacttaccttgtgttgccaagaggaaagaagtggcttttctgcaaagccaaatagtttttactttattgtctgctatgaaacagctgctgattccaggaaaatgccgtctcatcattgggcctggggtgtccaaaagaggcaggaaaaaaaaatgactgtagctccctgtctgccctggcactctcctcctttctctcattttcattgccatgaagagcatgagaacaatattctgcaattaaggattccattaagttgaagaaaagagcaaatgggggatgtttgttctctaagctgaaaaaatttgtctggggtcggggggggggatagtggtagtggtatggagagaggtgggtggagagacgaagtcagggctgtttgttgaatatactgttaaggactgttaccatcctaattaatcaagttagaaattacagctgtagtcggtttccccccaattcttgttatcaattttcttctcttttgagacaaagcaaatataaattttgtgttcatttgtcattcgttctttgacttcagcatctctgaaaataacaatgtagcacaaaagcccagtatttacctagttgtaatgtgggttgccatggtgttttgcaaattattgcaattatgttcaccatgcgagtcgcccttggtaactggcgaaaaaactgataatcctgttttgaacaaaaggtcaaattgctgaatagaaagtcttgattaactaaaagatgtacaaagtggaattatttcctaccattcagaaatagttcttgatcgggtttgggggagggggtgagtaagtacatctgattactgaagtacaaagcattgaaaggatgttgtcttgagcctttcatgtagtcttaatggtggcttttttgtcaaatttacccatttgcggcattgaaagaggcagctgcatttaagctggagagacggtgctttttcaagagttcagtgcatggaaagttctcagcagtatctgcagtttactagtagcccctggtctattaaaactgatgtgccgcatttgagcccattgctctcagtacttgtgaacccctctggctgatgatctaataaagtgctcttactggacaatctctgatcagctacttaaaaaggaggctggaggagggggcctgagggagaagcctcacaggcagtgagtcttggagcaggccagaagagtaaagacaagtggctaaactgaaaggtttgtcaccatgatgatttgtgctaaggcgtttgccacagggttttggtttttgtgccccagatctcccaactgtgatcatgctttttttctgaagagaaattttagttttaagttagataagagattagaagtgtctctctgaatgttaaaatctaccttgcaattgtttcttaaattatggccattcagaaaatatataatcctacattcatgtaaaaccaaaagtttcccatgttgcagccaaaggttagatggatttcttctcttctgaatctggcagaacatctgcagggagtgaattttggagggagggagtttttttttgtttttttttttgttttttttttagtgaccacctgaaaaatcaattctcaaaacttttgagagtgtgtgaaagtggcatgaaagcaaagcaaaccttaacaagtttgtgggtttacattctacatcacctagcaacctcctgactcagccagatctcttgtctacccttagttctgtttacagactattcaaacggcccttcgaaaccatgaaagatattcagtttcattagtaccattctcaaggagaaaataattaaagttaaatgaacaaacattgcctggtgatagtttgaactccattctgattttaagatgtcctttgaggcagtagtagctatagttcagttttaacatttgtcgttcactacccaaaggcatatcacttgaaaccataccaataaatactagtctctgagcaaacaaacaataaaaattacttttagctagacttgagcaaagaaaaactcttctggtaagaaggttttaagcatgcatgccattccaattgaattttgttttatttgattcttaccccaggacatctgagttgatctgtgtgcacactgaataaaggcaggggagagggcgtggggaacaaggcacctttctttaaaactgatttattacctaccttcagagatccaccatcataaagaaaggtattcaaatcatattccataaaagactgggtgcattttagtgaatggcttaatttaacaaatgatactaatactactaatacataccctgtcactttctcattgagaattgcttatgtgattaaatggacctatttttgaaattttagatttagtaaaaaaaaaaaaaaaaattttttttaagaacagactattttttttcatgtgccctttctttccccataagcacattccctgaaaatttatcttggcagcaagcatacacatggtatagctcagaatatttttcagctgtgttagtgatttaattatattgcaagctcttggcaaaactgtctcctcgttaataattctgattataagaacaatatacacttgttgtagaaaattttgaaaatacagaaatagaagaagaaaccacagagattactagtgatagcattgtagagtatttccttccagtcttttttttgtgcatatagtgatgaaaccaaaccttgagttcacttttgaagtttattcattattgtgtgtacatagctaaggtggtggtttttttcagaagtgaagacttgacaggcaggaatggcgttggaagtaatgaacaatttttcttagaggtttcatcactaaaacattaatataagcaccagagtaaccattttaccatctcattctatttgattctttcctcctttcccttgttgaaatgactatgtgccttacctgacacatccatttattatcattcatgttagaaagtcagacattcattacagttggaatgttacatccccaagtcacttgtagcttcatatagggggaaaaaagtattttctgaaaagatttgtaatataatagagattaatggaatgtggaaaggaaaatgctttcggtttctcatataaaatgaaagcagggtggctagaaaatcttgtattcttgttatttgtattttgttagatctctaacatccacagtacatgactgggttgcatgagctctttgtgttttgttgacagttgacagacaaagcaaaattattcctgaagcaaggtactgtgtacttagttgtgacctattatagcctaggaatgtagcttgcttttgagttggatgaatagggagagtattttacagaatagacttgaatatactaagagaggttttttagttgcccatacagaaagatacatgtcctctattgaacttttttccccaaaatgtaattttccatataaagtcttttaagtatattttccctggttgcttgcatggagacagttttaactgttctggtattgtcctctaggggtaaaatacaattgctggtaattgttggccttctgtgctcacagtataacgagagaagatggcttgcatgggggctctttaatgtacctcaggtacatcttctgatgctcaagctctgattgcaaattaaaatagcaaggctctgtattggatttgatgtgaggcaaagcagaccaagtcgctaatttatcatgtaatatacaatcgctgaggctggaatttgtccacttgtagtgctattctgtgtgtttaaatgaggaccactgtttgcatccaacctatcataacagtttgggagtgctccattatcctttcagcaaactgatggcagagtctggtccttgtacaaatgataagatcaataagtttcaaataacttggatgaaatgacatatgactgttcatttaaagagatgtcttacttaaaaaatcaattttaataatatttaagattcttacattgaccgatgaggcactttctacttctgttttgataattttgttcaaaatattcttgtattaacttcggtgaatagttagtttatgtatttatttttcctgatttactctttcatctcctaccctagtacctttctgggacttaataatcactctttgacatgccagcatgctgcagtgtagaagatttaactttaaaagcaaaattatattcctgttaaaacttcccctggagatcttagggaaattttctcccagttttgggtacaaatgtgggtcagaaagcaatttgttttttgatatttctggaaattccaaatcacaacatgtcattcttcaaaagcagctgtgggcccatactgtgcactatctataaggagacccattttttgccactggggataattctgtggcagaaaaatgtgcctgcaagggaaccccggaacatttataaatggtttagggtgaaaagagagtctgatgttctcagagtacatctagttttggtataggggtggttaatggccattattgaaaactagtaataatctgatgaactcaaagcatgcatgctgccagaccccgtcctgtgaccctgtcactgcattcctggtgagccattacaatttaaactaaatcgtacgtcactgcagaaccatgctgtctcttgaaaatccgtgaatccggaaataaagcaaagacagcctcctcttcccctgctgcctgttttgccgtctatatcttcactatattttagtttgatcaggaaaaaaatacgaaaatttcacttatgttgactacacagttgtaatattttgcattcaaattgagaagcagcaccacctaatcttactgtttatccattattttagttctgcgttttgtaataacaccagatggacactgaccaggctctttcctggttaaaatggtgcatttttaatagtgcactgtcagctatagcttagcaataatgttccccaataccagagacaggataataacaatattttacatttactcaacatttttgtgagttttcttatttgatcccctgaacaacactaatagagtaaatattacctcctgttttatagatgaggaaactgaggctcagaaagaggttcagtgagttgcacaaaattatctgttagtaaatgggaggaaagaaaccctactcatgcagtttttcataacctcaattctgtattcttcgttgattgtgaacctttgtggtagagactggggaggacagtaccagctccaaaacaaattgttccccaggggaccgaccatccatgtaggtaggcaaaacaagatggtaaaataagatggttaagagacagtgcaccgcagtgtgtgttcagcgttaggtggaataaggaagaaatccctgtggatcgggaaaatttcacaaaagacgaatggaactgatgatcaaggaatcgaccttttaggcagaggttctccagcctgtataatgataaggaggtgaaaacaggcaaaatatggtgagtacagtgagaaaaccaatctgattgggcagtaagtttgtgtaagagaatgatgagaaagggcaggggagtgggatgaggttgtaaggatttgaaagccaggccaatgaatttgttcttaattgtttgtggaaggtgtgtgattgggagatgggagtggagagccctttgcattggatataagagagaacggagtcagggaaaccagggaggaggctactgaaatagaacagtctgaggtctggctttgatgaggttggtggtaatgggactataaaggaaagaccagtggacaaacttggtgactgattggaaatgagaggggaagggcccactatgtatttgactcaagtatgcaaactactatgcattgttattttccttattgttttttataaacttgctcctctacatttttatttgattgcttctgttcatttattcagaagacttttaaaaatataactccaacttttattttagatttagggggcacacgtgcaggtttgttacatgggtatattgcatgacactgaggtttggggtacaaataatcctgtcacccaggtagtgagcatagtacccaagaggtagtttttcagcccttgcttccctccctgctttagtagtcccagaatctgttcccacctttatgttcatgtgtacccaatgtttagctcccacttataagtgagaacatgtggtatttggttttctgttcctgcattaatctgcttagcatgatggcctccagctgcatccgtgttgctgcaaagaacatgatctcattcttttttatggctgcatactatatattccatggtgtgtgtgtgtgtgtgtgtgtgtgtgtgtgtgtgtgtgtgtgtatcacattttctttatccagtccattgttgatgggcacctaggttgattccatgtctatcatgaatagtgctgcaatgaacatatgagtgcatgtgtcttttttgtagaacagtttatcttcctttgggtatatactcagtaatgcagttcctgggttgaatggtagctcttttttaagttctttgagaagtctccaaactgcttaccacagtggctgaactgatttacattcccaccaacagtgtataagcgttcccatttctctgcagccttgccagcatctgttattttttgtctttttaataatagccattctgactagtgtgagatggtatcctattgtggttttgatttgcatctctctgatgattagtgataagcattttttcgtatgcttgttggctgcttatatgtcttttgagaagtatctgttcatgtcctttgctcactttttaatggggttatttggttttcacatgttaagttgtttaagttccttatagattctggacattagacctttgtcagatgcatagtttgcaaatattttctcccattctgtgagttgtctgtttactctgttgatagtttcttcaaaagatatttttgaggacctcctatgctctacagtttcagatctagatgatttctgtgtgtatagccttctacaaatacaaatgtacacaaatgaataacagtttgtgtttaaggtgcaactactaggaacgcctcagttacaagtggaaattgatccctttttaacatgtgcagaagaagccattttagttgaggcctcaaaaatataatttagtaatcagaaccaatcaacatttgacacaatttcatacacaatgattttaaggaattagtgatgctgagattaaagcaacaagtcatagagcttggcatattttggtaaaggtttgttttgctattggacaggctgacttcacctcttttgaactttctatttataaatgtggctaagccaggcaactaaaaatttattgaccttattgctattggttatgataatttgtgtgcggcattacgtaataaaattacgtatttggatagcagacatccttaaagtgattctagaggtttttattaaaatccaaatctttttataggttgagtagttccaaggaactacacttttattaaaaatgttctcttctgtttacttgtcaatgtagccttgggctgtacaggctatatgttatttctgaaaatgaggaatgaaagtaagttaagttttgtctttgtgagtgatcaatcagagtgaacttatgcaatattattattttcatttgctttgtttttgtcatttttaagaaacaaaattcagtatgagatcttataagatttgcatcatcatggaatattttcaaatacctgttatatttatttatttttattaaaaaaaatttttttgagacaggatctcactctgtcaccctggctggagtgctgtgacataattacagctcactgcagccttgacttcctgggctccagccatcttcccatctcagcctcccgagtaactgtgaccgtaggtgcgtgccaccactcccagctaatttttgtatttttggtagagacagggttttgccatgttgccgacgctggtcttgaactcctgagctcaggcaatccacctgcctcggcctcccaaagtgctgggattacaggcataagtcaccatgcccagcctatatttattttttaacagcacaaatgttccttgaaggttagatttagctagccggttggcatttgttgggggaacaaggggttaaataaaatgtactttacaaaattgaattgaagcaaagcatatatttaatatgattagggcctatttcctacatagaagagttttgtttaaaatacaccatgaccaaaagcttaattatcaaaataaaacaagaagcataaagagttacaggcttctaatatttttttcagccccagttcccttcacacagttatcagcatgtttaatttccatgcataatagcactagttattgttgtcatttgtaaagggagattaacagatagtaagtacaaacaaacccaaataagcactgaatagagaggtgacaaaggaaaaaagacctccttaatgttaattataactggtaggaagtctagacaaattatattatctgttttccatatgatttgaaaggacatttagttagtacctctgtcagagttaggtgcttgctttaaaaacaggtgagatgataacttagcatgtccgtggttggcagctcccccagggagttgtgaagtcgtagtaaattgacagaatcaagtttcaaaaacatctgaaaagaactctatagtttttgaacattatattttaaaaattaaataattttaatatccaggttatattttggaactgaataatttcttatctcaaaacctgatagttattacctgtctgcttattttttttagttttgtttagaattggatgaattacaactatggttggcagtgttaactaactacatattccaaagcatgtaaagcctcagataccaaatttaaagtaacaaacccaatgaatgataaaggagtggtccagtcctgtatggtttgtttcctttattaatatacctaaatgggtacttcaagaaaacaactagtcttacctttagtgtttataggctacatttaaaatgtaatacctgttcttgctgtcagctccactattccccactgtatctcccatgcctagaacagactaaaccgaagtatcttgtttctctctctctccctccctccttctctctttttttttgagatggagtcttgttgtgtcacccaggcaggagtgcagtggtgcaatcttggctcactgcaacctccgtctcccgggttcaagcagtcagcctcccgagtagctggaactacaggcatgtgccaccacactcggctatttttttgtatttttagtagagacggggtttcaccgtgttagccaggatggtctccatctcctgacctcgtgatctgcccgcctcggcctcccaaagtgctgggattacaggcgtgaaccactgcgcccggccagtatcttgtttctttaattctaaggagctgattgtgagctgcactcttgacttaacagcttttttgaaggaaactaaagtacattattaagctgtacatgtccattataaatgcatctgagtttcagaaatagtaaaacgtgaatataaatgtctctctaaatcaagaagatgttgtaatacaccctcaaaattaaacagctgcctgtgactccaaaacactgattggttcatgatcttttgctgtggtagtagtagttcatctcagacactaatctgtcccttctctgtattgttagcatttatagttggtaccacgcaacttggttcttaaagccaagccatactgaattgcttttatagtctttatgtgtgtggaccttgctttcctgtttagattgtaatttcctaaaactgtacctggggcccttttgcctattcttcacaatatttaatgtaattctgggcatatattacaagtttcattaagggctcattgagaccctccctgtacttgaaaagctcatattaaattttaaaatagtttagccttgaatgaaggtaggaataatgcttactgtgggtgtattgactagatgaattttacattctttaaaggtagcataatttttttattcatacagatctataatacactttccctttttgtgatagtcttaaatggagctagaagaactgattcttggtgctttcccctgagttttgttatagctacttccagaaaagcctattccgaggaatgaggtcaaacggcacagcagcaagtgagggcatccctcagctttggattaacaccacatggaaacattactaagtggcagactaaagtacctgacataatgaaccaacactcatgtatatactgctcttatctaaggggaaaagaccaacaagttgttcagtctagaaataggatatgtggttatgcgtgttattgattcctttattaatgataactcagcatagctctttctggcctgcattctttgacatacattgttctttctgtgtaagttgtcttttctgccttctctacttaccaaacttccactcatttttcaagaccggttcagaagttgccatgtctcaaaatgctccaagatctacagatagtcaggtccctactgggggctccacaggtgagaacaccataagacaagggagcagcagcataccgtgttcacctttataccccagcacctcactctaacatttgccttatacttacgcctctgtggcaatgcatgtagcacgaaagcccacagaccttggtgccttagtatgaacaggtgaactttgaccccatttgtgatgtcttacctcctttgtttaacagataacgttttataacataagactgatttaaggtcttaggtatattcttatcacatcactatgagaaaattcaaacaagatcagcaagggagagtaactgaagaaggaaggtgagaagagggttctaaaagacagagaagtgagcgatagctgtagtatttcaaacctctggaaaatagtgatcagttgaagttgtccttgaaaacattgaagctagttttatgtctctagaaagcacatataagagaatctatttttgtttgcatgaaataattgattatatttattaagtgtttcttttatgccaaatataatcctagacactctaaatgtgttccatcattgcaacaacggtatacggtaagtactgtggtatccattttacagagaaggaaacagcacagcaattaagtaactagccaatagtcactcagctattgggaaggttatacatgtatgtggtgcattctttggtaatggtctttactaatgaactaaaacacattggtttacattctgcctgtagtagaagtttttgttgggaagttttgatgtattggagtgaggaagggtgtttcttttaagaaaaaaaaataacatctcatgtgattttcttttttttttttttaacttaatggttttcctaacttctaagtttggggcatagatctatctaattaacatgtcaggagagagagataactagagttatgtcagaatttctgagaaaagattaaataaaatgagtctatcttgataaccaaaaaaaggtttattacttgtatttgtcgatggtgataagtctgaagttttcccttctctccagggctggttgatatgtgaagagccaacctgtcgcaatcgaactcgtcaccttccccttcaattctcccgaactgggcctctttgcccagcctgcatgaaagctacacttcaaccagaggtaacagtctcataatgctaaagaaccatgtagaagagggtagagggctgcttgctttgagaagtagatactgagtatttgccctatgaagatgccctactaccatatgcatatactaatcttatttttaaaaaatacagatttcagaaagatacatgctttctttttttcacatgtcatgagcaatactatatttatatttaaaagggaaactgactaattctcatatgagttatagatttctttggttgccactacataattacaaaagaagacatggccattccattctagaaactgctatcgtctttgggcttgatcagaatcccatttgtaagagccagaaatcctcccaattctgtaccctgaatggtttattttgtggggtttttggtcccctctgctggattaattgtttataagtagctgcatagatgagtagttctgaagccatttttctttgttttttgtttgcttgtttttttttttttttttttttttttttgacggagtcttgctctgttgccaggctggagtgcagtggcacgatctcagctcactgcaacctcagcctaccgagtagcttgggactacaggcgcgtgccactgcgcccagctaatttttctatttttagtagagatggagtttcaccatgttggccaggatggtcttgatctcttgaccttgtgatccgcccacctcggtctcccaaagtgctgggattacaggcatgagtcactgcacccagcctgttttgtctttttgagatggagtctagctctgtcgcccaggctggagtgcagtggcgggatctcggctcactgcaatctccgcttcccatgttcaagcgattttcctgcctcagcctcccgagtagctgggactacaggcgtatgccaccacacctggctaatttttgtatttttagtagagacagggttttaccatgttggccaggctcatctcggagtcctggcctcaggtgatctgcctgcttcagcctcccaaagtgctgggattacagacgtgagccaccgcacccggccactcaagccatttttctaccttaatatacacacctgaggtgtaagacatactatcattaatgactcccaactagaaagcatggcatctggaaacacttctctggtaattaagatgccttccctctgttgacccctttgagcatcttcgacccaaacagcattttccaaactgtagtgagaagtttgcaggttctttgagcaaagagggttttgtgatcaagtatatctagcagatgctgggctagctaaaattaaacaagtttattgcagatcttttcagaacctataatatgataatgtgcaatctgtctcactaggacaggtccataatgtgcctcactttccaaattcgtctagcctgaagatttgtaaggtttttagtgagaagaaggtgagacttgggaacctgttgtttatttacttacttcttaaatgcagaggcaggcctataatcaagttttgacttcaaattttcctgctgaaaagggttgatacacagactagttttagaaaaatatgtacacacagttttagaaatggagtcctgctatgttgtccaggctggaatgcaatggctattcacaggcgcaatcatggctcactacagccttgaatttgtaggctcaagtaatcctcctgcttcagcctcctgagtagctgggactacaggcatgtgcccagctgaaaatattttattttaaaataataatgacttaattttaggataatatatcatttcacaaaatttggcaactagtcaggaactgcaaatagctaccatcgttgtgtattcagttgttcttttgcatatccatatgtatttttttacatggttgccatcacaatgaagatatatacttgtatcacatttatcttttgtcaagcattttttctgtgttgtacttcattttcagtacgatttttttttttttttttgagacagagtcttactctgttgcccaggctggaatgcaatggtgcgatcttggctcactgcaacctctgcctcccaggttcaagcaattctcctgccttcgcctcccgagtagctgggactacaggcgcgtgccaccatgcctggctagtttttgtatttttagtagagatagggtttcaccatgttggccagactggtcttgaactcctgaccttgtgatccacctgtctcggcctcccaaagtgctgggattacaggcatgagccacaacacctggcctccagtaccaaaaattttaaacacaaatttaactatacctttcattgggcattttaggctattttcaatatctctacttgaaattttgtgatgaatatttttctgcttaaatgattttttctttatttgacatttaggataaattcttatcaacaatacatacatacattgcataaatacaatatggtcatgatttatattgccaaattgctttcctaatgggctttcccaacttatactgtataccagtactttatgaacataccagttttaccatagcctttctaacatttggacactatcatttattttttaaaactaatttgatcagcataaaaagttccttgccctttttttggtatacctttgatgattagcaactttttttaaaatgtggaatgttagaattagctgtcattgaattatttttacgtcattcttgtctcaagacttgcatcagcaggtgcagagagagaacaaaagtgtatgtatttagtgtgactcatcaatccggttgtaggctttaggggaatcaccttgcttcatgaactgatgctgcctttgagactttttaaatatctaactcatcaagttaagttcaatgaaaatcaaattacttcttagaaaatcaaccagttttatgattgcattcttggtaagagaaggtaaaaggttagtctataatcttagatcgttaagctattagaccgatacatttcgaggatgatgttgatagtggtttagtatatcaggttatcttttaacatttattaatctttttagatttcaaagtgacttgtttttttcttcatatccttgtccttctcaaaactgcagcgttttagacatgtgtttctcaaggttatcagctactcttcccaaggagaagctttcatagattagctcctctggttccggtgctgctcaggacatgaccctatggagttactcagtttcagagcaggctggttggtgatactttccttagccattcctgacagggaccttgacagtgggactcagaacactcttatgtactcgattttgagttgctaataatgggcgaggaatttcttaattctatttgtgaggttcctgggcttttctagtaggagggaaaaatgcatttttccaaagatagttctagagaagttcaaaaaacagttgtgcaatggacagaattattgtaatcatcagagggttttccaaagtatctattctgcaggattatactcatctggttctcaagttctcagttgctctgtctcaatcataccttactttcatttaataattatttattaaacaactgcaactacatcctaggcactttgctaggtgctagaaacatgttaatgaacagaacatttctttatttataaaactattttaacattacacagattatataaaattctataaagttgatatctgtgggcaaaaataggcatttataaatgcccatttggacagaacactagacattcctagtgctagactagtgggagctttaaatatgttgttcaagtttgatggtaaagcactggcctcttactgtgccagtcttatctgcacataataaacctattctcacttagtcctgggttgcagttgacttgagtactttccagaattgacttggagtaggaaagctggctcttctgctggctcgcattgccagagttagaagaagaaagccgggacagtttttttctcagggttttacacgtgtatcttctctcttctcagatatttcattcatatatatatatatatctcacagttaagttttttaggctcatggaaattcccagtatacaagttgctgcttaagacatatattccctgagtattttttgctatataagaggtgcatttaaatacgagagtgaaaattttgatgcatgtttaagttactaagtaaatagaaccctctttgacaggatcattcatgtgccaaacctcagcgtcacacaatatacccatgtaacaaacatgtacacgtaccctctgaatctaaaataaaagttgatgttatttttaaaaatcgaactctatcatactggtgatagagatgagacttacccaagttaggcaataaatattttagtatctctttgttttaagaatgtggttttgactttttaatatggtgaaatgtgtatggatgtgtatggaatccctccacagaggattctgtattagtaattcaccaaaaataaagctttctggttttgttgttgttattattattaatctctcattatcgaactgggatttcaaaccaaattaaactttttctcattaacgtattcattcttgatgtagagctgagaaaatgtctgtatgtgactctcacgatcatggtagaaataatctgtcgaaactgtatagtccctggggcaggagcagtatagtggagccctttattcaattatttaatcaactaaatttcttgaaggtcacttataaggaaagcagtgaaatgacttctagtcctactttgagaaaccccctagtgtttctcacattttcctcacttgtaaaattgctaaagtctattataacagaacacataatgtgtaccattgtaggacttctgtccttaaagggagaggagaaataatgaacttataatcattatatgttaccatctcaaaatggctatggctgaacaaattgttgatttgatgagtaggttagggacagtgagaatgttgccaagctacctggggaagtttcttttttcagaagaaaacatgaaaataattgtggtctcttaaggcagtaagcatgagtccgtgtaggaagagaaccttagaactatgacctaaagtcttaaacctagtcattggttattctccagtagggaatggtggtttaccatgaagggtcttttggagctctcctttgttattttgacatgcatatttgatgcaaagagattactaaattctatttacagcttctcttactgccacatgggtgctagcaacctttttcaatttacttttttttaattggggtataattgacataacataaaattaagtgttttaaagtgaaccatgcagtggcatttagtacattcacaatgctgtgtggctaccaccagtatctagttccaaaacattttcatcaccccaaagaaaattccatatctattaagcagtccctccccatttccccctccttctagcccctgttgtcactatggattgtacctactttgaatattttctgtaaatgaaattatacgatatgtaaccttttgtgtctgacatctttcacctcgcataacatttttgaagttcatctgtgttgtagcatgtattagtacttcattcttttttatggccaaataatattccattgaatagatatgccacaatgtgtttattcatccattgatggacatttggattgctttgtcagtacacttttaaagtttatttttaattaagtagacaggtcttacatttggcctgaattttttttttctgtagctcactcattggtcctacctcagctgaatggtaccacacaaagctagactgatccctttttctgtctctgccttcagtaagcacttattcagcacctattcaatgcccatgttatgagagcctcttagacatataaaagtagctgtcttcctgagtgttcccttctagacccaatattcctgagtcttcgtttctctagagctctgctttcagaataatgatcttagtaaagactttgtgtcttgataaattgaggagcccaaaactgcgtgcagtattttaggtgctctcactagcactagtatggagcagaagaaacctgtcactgctaccttttctaggtagtaaatttctgttaagtctgttcagagttgtgttaactttcttggcatccatacttgcagtgtttttcgttttgagcattctctaaattaaaatgcctagcaattttttttgtacatgcatctgctaagccatgtcttatcatggattttttggacccaaatggcttatttagacctaagtgtaagacttcagtaggtagtatattaacaaagtactacaaactaggtgacttaaagtaatagaaatgtattacagctctggaggctagatgtctgaaatccaagtgttggcggggccattttccctctgaaatttacggggaatccttccttgccttttctagcatctgctaatccttggcttgtagatacatcacttcaatctccgcttctgttgtcacatggcagtcttcttccctgtgtgtctctttctctttttcttataaggacaccagtctcatattggactaaggcccagcctaattcactgtaacttcgtcttaatgtgatttcctgtaccaatactctattttctttcttttcttttcttttcttttttttttttttgtgagacagagtctgactgtatcacctagtctagagtgtagtggcacagtcacagctcactgaagcctcgacctcctgggcttaagtgatcctcccaagtatctgggattacaggcatgtgccaccatacctggctaatttttatattttttgtagaaactgggctttgccatgttgcccaggcaggtcttgaaatcctgggctcaagcgatctgcctgccttgacctcccaaaatgctgagattacaagcatgagccactgtgcccagccccgcccctattttctaataaggccacattcataggaactcggggttaggacttgaacatatctttttaggaacacaattcaacccattacaggtaggaattgcactgagctaaaagtaatggagaccaaaactaacagtagcttcaaaagaacagacatttaattctctaagaaacattcattccttatcatgtgaaagaaatccaggtttgggctatccaggattgctcttgtggctccacagtgtcatcagggcatagtctcttcctgctcttttctgtcattctcaaagtcatgatgtgttcccaggagactgcacacgcttctgaagccatcaaagggtacaagatggagaaaaggctgaaggatccaaaggatgtgcttcccagccttgtcagttctttatgcagcctttctagaagttccattcaatactcttgcttgcatttcgtgggctagaaattagtcatgtggaaataattgctctttttgttactaaagaaggaagagtagactgggtattggggaccaaccagcactctatgcaacagagaccttccaatgaaccctgtcaaatctccccttgctggcctcagcccatcactgttccattgtgggatttttgaatcctgattctgccatgtacccagccatttggcttctgcagttcttggagaagataaaagatctctcttttgtcttctccaaagtattggttaaaatgttgaagtgcatttatgcacaaaacggtggatagatgccttcttctagatggacattgctccattttaatcagtatgctttgtgtaggattcttctaattatctttgcttctagtttgtaattttccacaaggggaagaagccctacttctaatgggcctgtagtctaatggaagacttagggaaatacaaattttccacactccattgaccaaagggacaaaaagggctgcaacagctttgtaatcccagtgctccctaatcaataaggtaggaaagataatagagaggtgaggatggtgattattagatgagagccttgatccttaactgggggcagttttgccccccagggaacatttttggttgtcataactgggggttgtagctggagtggggagggaggtgccgctggcatctcttgagtagaggccagggatgctgctaaacatcttgcagtacacaggatagcttccagagctaaagaatgatgcagcccccaaagtcaataatgtcaaggttgagaaactttggactacagtaacctgtccaacccacagcccatgggctgcatgtggcccaggacggctttgaatgcagcccaactcaaatttgtaaactttcttaaaacatgaggtttcttttttgttttggtttttggtttttgggtttttgttttgttttgttttgtttttttgcgattttgctgttttgttttgtttttagctcatcagctgttgttagtgtattttatgtgtggcccaagacaattcttcttcttccaatatggctcagggaagctaaaagattggacatccctggacattgagggtatctagcacagatgccttagagtagaatttgaaggcagattttaaaaaggacaccttttagagtggaacaaatacatgtagcaatggctgtgattggttgggtacagagaatgacatgtagacttttcatggctgttaaagagtatagaaggcaaggcatctagaagatgaaaacagttataaaatagtacccctttactaccataggcagaagctttcattttaattagctattgaaggtatttgctagattcgtaagacgagagactgggaagcctaatttaagtgcaaggtgcttaacatgcccttgatacggttcgaagagtttgaagagtgcatttgggagctgtgttggaattccagggagcacttcactttgctgatgggctgtctgtcctgtgtgaatcgagtacagaaacagaagatagtataagagccatgatgctattggatgagaagggtcatgtgctagtaaaatgtgattatatatgctctttattggtgaggtgtaaatatggccctggaaatctagagacctatgtaatcttagagaagtcattttaccttttgggacctcaagttcctcatttgtaaaatagaaggcttacagcatcagaaaaggcccctcaaaggagagtggactttgggaggaaaacaggcatagggcacagaagtggggggctgttctggacaggaagatgaacaaatgccttcctcttctcttcactgcccccccccccaccaacccccacctcagcagagggaagggatgcatctgctatccccactcatcactggactccccaagggccaggtgtgcagttcgttcacctcagggagatccagtgcctggaactcagtgcatacccaagtgatgtttgttgaatgaatgaatcttagttagagcccacgtctacaaacgaaaaaagagcaaaaagcttgtttccatttccagttcttgtttctgaagaaaatgaagggcttttctttctccccagagaccacatcttcttggcccctctacctagaccaatgcagagatgttccagggatgttcagtctagccccctttcagttccttactctttcccacctattcctctcccttcttagatccttcttgtgtttatgcacagtatttgtttggcaagtgccttgggaactagcaaaaccatgaggacattttcctgtcaccgataccctctaatgtgtcccttttgagttggcagcttaaactgcttgctgaataaaacattaacttcttcaccccaaccttgtccttactcaattctggcttcacagctttattgacagcaatgcttatcaacccacttttatggtgggctgaaagagattgactattattgtgcccagattaaatgggggagtaatgccacccctgtctgattgtgttgtaattggtcagagttatatacaggtgcaatttgtaatattttcagtaaattaaatttttttctctttggcttttattgatgtatgttcagatgcccattagggcttccttttttccagtggaaattgcagcatgttaattttcacacaaattacagcaatagcaggtatctctatttgatacattataacaggagcaatcaaggataattgagtgcctttcagatggaaacgggtgcattcacttcaattcaaagcgagtccatttatcgcctaatcggtctttaaacactaaatttctggaacaaaaattcttgtcataattttgcttaagtgtatttggaaatcacagtcctttgagcaaggataattgaaatcaaatccctttcaatggaggtgacatttctacattttcccaattgaaattaatttcaaaaattgagcatgaatatcttcaaatggcaggcaattatagctttcaatgggaagaaattatgcgcacaaaaaagtggagacatcaaataccgcttcagctaaatgtctttgtttccaactgtgtttgccttgtaaagatttacatatattgacttattatgcaaccttgagatgcagatcgccttcctttttcatctgagcccattaaaattaactaaaattggaacgttcttgttaagcttcatcaaaactgtttggaatttactgcagctgcagaaatgtgttcataatagaacttaacccttcaaagacttgaattctacccccattttttttaaatctggaattctaacttcagcgcatttcattgtttcacttttaatgattcaaaagaggagtggtgaagaactgatatgctaattgtcttctctttttgtcatctggtacccatgggatctcaggtaaatctctggagcctgtcccctttgaaaactgccctgaaggacaatactgagttcccagagggcaccaatatgccaacctttaatatttaaatgtaatcatatcaagccgatttcccactcctcacaataggaattgctcttattgttggactgtgacaaactctgtgggtttcctgctgcggaccttttcctactaagaaccttttctcccaattgttttattgccacattaatgctgctattaagatccgtgtgctataaattagataagctttatatatttttttattcatcgtgactttcttctgttttccaagggtaaaagtatattgagaactgactcttgcaagcacttacttttcgaaagtagtttagaagcaatctagccatgttttacagttatagcggcaattgtttcaacaaccccaaaaaaattgcattactgaaatatatttcatgggtgcaattggccagggacagggagggcagcaggccatttcttttattaaggtcttgcgcaaatgttatgaagagggcagtatctcaagaaacaatttcacagctggtttgctcctaagccactcaagcctaaaaatgcaccgaattcctggtggaaaaaaaagaaatagatgtcactcccaaacaaagacaggtgctaagctgcgggagatgagagaaggggtgaaaacagtatccagctttaatagcaaaagcaaatgctagctaatggcccattctcaggaactcgttaagtcatctctaagcaaccacaggataatacactcgttatttctgctggtatgtttcctaaaagtgaggcgtattgctttgagcccagaatcttagtggatagtgcgcctcacctctgtattaacctgttggcacgagacctttcctgccgtcttatgccttcttaatggaatttttattagtcatttgggtgttcttttttactttattttctttgctcttaatttttagctttttaactaaaaatgtttttaagttacctaatgttttttgtgtcctataagagaatttccccccttggttcacctgctgattggtttttgtgtatgataaattattcagagcttatgcaaagtgtttaatgtattttccaagttattgttttagtggaagatggacatttgtctttgggtaggaatatgtgggttttttacgttcaaagcaggagttgttttctgctcaaatttgatatttgttagccttgatgtttgaagtactcatcggtgaccaataagctgttatacagccttgaacactgactgaagggggtctgaaataccatggggattaaaaatagcaaaaccacatgctgaaattagaatttatatttagacgatatattgtctttcactcaccctgcagaattttatttttaaggctgtacattgtgtggctctgtgtttctcattttagaaacacaaggaactcactggaaagccagacctggttaatacaaacatagtctgagtaaacatacaggagttgctatgcaggataagggcagaacattcttcaccaacaccacattggttcagtataatcacaaacactgaaatttttctttgtgaaagtgacactgtgaaatgtgtaacaaaatttttcaaggcatttggggatgtatagttcagcattcaacaggaccaccaaagatgtaggcagatgcatttccgccgcttcaaggaagggtgccgaatgtgcgcaggccctctgtgctatccttcattgttcctgcatttaccttcctacttctatgcaatggagtgcaaagcttgtttattggcagtcctgaaggctttgcagaggtactgaatggtggaaactgagatttccaaatcctcctaggttttagggcagcactctttaaataggatttctgagtcccaaatctttcttatatccttgataatttttatattatttcttccttcagacataaccttgatatgggctgtgtgtccttggaatgccaagcagagatcattttatgctttgaggtcatagttataaataatgttacttatcatatactccaaattcattcagaatttagtgagcacctactctggaccaacactgatacagccagtaggtatacagcaggaatctaaaattaagtccctgtcctcatggaacttacattccagtgtggggagacagataataaacaataattatatgacatggcaggtagtgacaaagtactgtggagaagaattcagctgtgtgagtaggaaagggactggcacaagtagggtttgttaatttatgtagggtatctagggaagttctccttgaaacagtaatagtaagcaaaggccagagggatgtgaaacagtgggccttgcagatatgaagaggaagggcatgtataagggatctggaacagctagtataaagggcctaagataggagggtgcttggcatatttaaaaaataggaaaagggccagtgtagcaagagaaaagggaacgatggggaaagccgaaagaggtaaggtgagagaatttgggcagagggtggagacactgtgaagagccatgtaagccattgtaagggctttagtatatatgctaggggaaatggggagctattcaggaattccatgtggaagagtgcagtatctgactaagttgactgctttgactgctgtaatttaggcaaaatatgttgatggtagcttggcccaaggaatagaagggaatctgtgagaagtggttagattcttgatgcattttaaagctaaaactgataggagttgctactccaatccttcttcccctgtgacgttatatagaaggaaatggaggagagattccttcttacaggctactgattctcaattgaattctaatgtatttaattattcacctaaaactaagatcttgcctatggaccccatatagcatagcagtatccttactcttaatagactttaggggaaaaaaatgagttgtgtttgactttcagctcacagtctagccaatgaggcaaaattacagaaccagagaaacccctctgcgcgtgcatgtgcgtgcacacacacacacacacacacgcacacccctgtacatgcatgtacagatccctgaaagtcatgagaagcacagctggaatgagccattgtctcagatgggtgtgtgttcatatgcaggtgtgttgaaggggtggtgggaagtaattaacaactgctgtactaatttttaatgtaaacatgtacataagtagttagaggagatgataagagaagattgcatagaaaaggtgagatgtaaactaagactggtaggatcagtaggatataaataggtgaagttgaggaggcagaaagacattcttgtcagtcccttctctgtgcttctgcttcgaaggtagaggatttggtgccttctactctttctctacataatctatttagaagatgctccagtgttatgaaaacagccttaggaggctgtatgacatctacttagaaacagtagattgaagttggatctttagagcaaactattctatcatgtgactgttagactccagtttagtggtatcagactatgcccttctttttggatggttatagattaaaggaaaatcttctagggcaaatcttgaaattaagaaagtattaagggtgtgctccatactctgttccttgtttgtatccttatgccttgtccttccaccagtcttccctctcctcttcctttacactcagctgtcctgtaatgcaatgtgtgtgttcctaaaaatcactaagctatggaaaatcatataatgacaaccacacagtttatggaaaaacagaaaggttagggcaacacacaaaaacttcatcagtgacacataaaaaaggatataggaacctaaacaaaaacaatgacatagttttacacatcttcagtagctaagaaatatataaatattacaataaatatggtactttaccccgaaaaagacttgaagtttgcttgtggaagtggactcagaaggattgcagctgtgagtcatgatgacgtagagaatggaaggttatctgaaattggaaggaaagttgcaacaaacaccagatgtgggtgagtgtagcacagtgaactgaggtagctggttgatgtttgaggtatttgcgtatgtgtgttttatgtattcctgtattgcttgggtgcatttcttgcattcacctaatatttcttgcagacaaaatcatgcacgagcaaacacgaaattcatgttgtgttcaaactgttccgtgatatatcaatggcactggaataaattctcatattcaaaacaagcgctgtagcagaaccaactgtatctcgttttgtcttgatgattaaccagcaccttaactgtctccctgctttattgttttctcttcattctcataatgtacaaagacactcgtatttttagaaagactgattggaacatctgtcaaccagataattaaacttattgaatattgtctatctccagcatcctggtctgggacgtgggaaacaaaaaacgttttgaaacaatgggttctgcctttatactgcttgaatatggggaactaagcgcagacctttgaagcaaaacaacagttcttaaaatatgacaacatatagaattaatacatcagtgctgaagagatagggtaaagtagttagtaaagagataggataaagtagttagtaaggtaaagcttcttagaatatataaattttgatccagattgtaaacaaagttgtgaacatggattggggaagtagtcccagaagatgaaaaccctagcatcaaattctaccagcattttggttccaggtaagatggagtaagaatagttcttattgtctccaaccgaaagcaactgtaaaacctggacagcatgggtggagcagttacatggagaccgaaaagtaaacagtagcaggtaggttaaagatgaagaccagatttcttttttttttttcttttttctttctttctttcttttttttttttaagaccggttcttactctgtcaaccaggtggagtgcagtggtatgatcaaggcaccctgcagcctcaatctcctgggctccagtgttcctcttgcctcagcctcccaagtagctgggactgcaggcacttggcaccatgactggctagtttttttattttacttttagtaaagatgaggtcttgctatgttgcctaggctggtctcaaactcctgagctcaagcacaccccgacctcccaaagtgctaggattacagacgtaagccaccgtgcctagcgatgaccagatttcaagtacctttaaactagcagtaagtttgccattttgtcccctgatattcccctgcctaaatgcagcacagcgtaaaaccaagcgtgggcaccaagctacagacagcaagttccaggagaagcaagtagtggcaaaggtaacacccagagagaatgtagaaatccccatggctttcttttgttttttttttttttcttcatgccctcatgcatcagtcttcaagtaaccttatggtggcaacagaagctgcagtgagagtcagcaggagccagaactccaaggaagggaaatctcttccctgaatcctctttctctttcttcctatccattggtcctaaatggagtacagtcacaaaaatacatgacaagttagataactaaagacacagctttctgactggaggactgaaaacaggagttacctgcagggaactagaaggtaccaggaagatgacagagaaagccttagggaaacaggccccataaggttgtttatgagtcgggtgcagtgactcatgcctgtaatcccagcactttgggaggccaaggcaggaggatcactcgaggtcaggagttcgagaccagcctggccaacatggcaaaaccctgtctctactaaaaagacaagcgttagccggcgtggtggcacacacctgtaatcccagctacttaggatgctaaggcaggagaatcgcttgaaaccaggaggcagaggttgcagtgagccgagatcgtgccactgcactccagcctgggcaacagagcaagactctgtctcaaaaaaaaaaaaaaaaaaaagttgtttatgaacttctgggcctgtggaaagaaagggtctaatcctaatcaacataccaaagacatggagaactgaaataaaaaccatcacccagaacccaggactacctagtagtgcacagaggagacagatccaaaaaactgcaaaagttttgacagctgaactgacattggcgacacagaaagtggattggagctcacagcccaaatttaatgaagtcaattgcctgctaaaatgaaaataccaacaattttcataggattgaaagaagaccctgagactcatactattcaaaatatccaggatataattctgtaagatagaaccaggaaaatcctataagaagaaccaggaaaatcacagattgctggggtgggggggtgggggtgggggaggagacggaacacgaacaaaaagatgccaatgctgagatgataataatattagaattatatgataaagactttaaggcagttattatccaaatgttccaacaagtaatggtgaaccccccccccctttttttttttttttttgagacagagtttcgctctttcacccaggctggggtgaagtggcgcaatctccacttactgcaacctccggtccccgggcttaagtgattctcctgcctcagcctcctgagtagctgggattataggcactcaccaccacgcccggctaatttttgtatttttagtagagacggggttttgccatgttgaccaggctggtctcaaattcctgacctcaggtcatccacctgcctcggcctcccaaagtgctaggattacaggcatgagccactgtgcctggccaacactttttaaatgaatggaaaaatagaaaatctcaacaaagaaatggaacatgtaaattatcggggaaatgcaaatgaaaaccacagtgagacaccaccttactgctgcaaggatggccataatttaaaagtcagaaaataaatagatgttggcatggatgtggtgaaaagggagcactcttacactgctggtgggaatgtaaactagtataacctctgtggaaaacagtatggagattccttaaagaactaaaagtataataccatttgaaccagcaatcccactgctgggtatctacccagaggaaaagaagtcattatatggaagacacatgcacatgcttgtttatagcagcataatttgcaattgcaaaaatatgaaaccaacataaatgcccatgagctaacgagtagataaagaaaatgtggtatatatacaccatggaatactactcagccatcaaacgaaatgaaatagtggcctttgtagcaacttggatggggctggaggccattattctaagtgaagtaactcaggaatggaaaatcaagtatcgtatgttctcacttataagtgggtatgttcccacttataagggggagctaagctatgaggatgcaaaggcataagaatgatataatgaactttggggacttggggggaaggatggagggggtgaggaataaaagactatacattgggtacagtatacaatgcttaggtggtgggtgcatcaaaatctcagaaatcaccactaaagaacttatccatgtaaccaaaaaccacctgtacccccaaaaactattgaaataatttttttttaactcacagagtggttggaaaccctcataatggtctccaccctcctgggggaaaaaaaaaagaaatagaagatgtaaggaagagtcaaatggatatatcagaagcaaaaaatataattaccaaagcaaaaaacttagtgggctcaatcatagaatggagacgacaggagaaagagtaaatgagcttgaagatagatcaatagaaattatccagtgtagacgaggcatggtgcctcatacctgtaaatcccaacactttgggaggccgagccggacagttcacttgaggccaggagttcaagaccagcctggccaacatggtgaaaccccatctgtactagaaatttttttaaaaattagctgggcgtggcggtacttgcctgtaacccagctactcaggaggctgagacacgagaatcatttaaacccaggagtcggcggttgcagtgagccaagatcatgccattgcattccagcctgcgcgacagagcaagactctgtcttaaagagaataaaagaaattatccagtatacagaagacaggaaaagactgggagggggaaaaaggagccttggggacctgcggaacaataacagaaaaatctgacagtcatgtcattggaataacaaggaaagaaggaccatagggccaaaaaattatttgaagaaataatatttgaaacgtcctgagttgggcagaagacatgaatttacagatttaaaaagctcagaaccccaaacaggataaaataaatttattcccaggtaaagcataataaaattatttaaaacaaaaaattctgaaagccagggaaaaatgacatatataagaaaaaaagatttaactgatgatatatttctcatcagaaaccctggagccagaggaagtggaacattttggaagtgtttaaacaattatcagtacaaatttctatgtccagcaaaaaatactcttcaggagtaaaagtgaaagaaagacattctcagatgagtaggataattcattgccagccgaccagctctgagaattgctaaaggaagttattcagagagaggggaaatgaatgctggaggaaacttggaacatcatggatgatggaagagcaacaaaaatgggaagtataatagactatttttctcctcttgagtttgctgaaatatgttttgcaggtgaaaacaaaaatcatagcattgtctgatgaggttttcaatgtacatagacatagagacaactacagcataaagagagaaatggggtctatatgtgtttttgcattccacttgaagtggtaaaattttaattctaagtgtgtacattgacattctgaagtatagactatataaagagatgtcaaaatccaataatagctaaattataataaaatttgcaatgttcaaataaccaagaagagggcaggaaatgggaaagaggaaggaataatcagaaaataaataataaaatggtagccccaaaatgatttttttttaatgatgcaactctaagctgccttcaagaaactcactttatttttattttttattattttactttcgtgtaatttctttttttattattattttagggtacacgtgtacaacgtgcaggtttgttacatatgtatacatgtgccatgctggtgtgctgcacccattaactcatcattttacattaagtatatctcctaatggtatccctcccccctccccccaccccacaacaggccctggtgtgtgatgttccccttcctgtgtccatgtgtcctcattggtcaattcccacctatgagaacatgcggtgtttggtttttttgtccttgcgatagtttgctgagaatgatggtttccagcttcatgcatgtccctacaaaggacatgaactcttcattttttatggctgcatagtattccatggtgtatatgtgccacatttgttaatccagtctatcattgttaggcatttgggttggttccaagtctttgctattgtgaatagtgccacaataaacacacgtgtgcatgtgtctttatagcagcatgatttataatcctttaggtatatacccagtaatgggatggctgagtcaaatagtatttctagttctagatccctgaggaatcgccacactgacttccacaatggttgaactagtttacagtcccaccaacagtataaaagtgttcctatttctccacatcctctccagcacctgttgtttcctgactttttaatgatcgccattctaactggtgtgagatggtatctcattgtggttttgatttgcatttctgtgatggccagtgatgatgagcattttttcatgtgtcttttgtctgcataaatgtcttattttgagaattgtctgttcatatcctccgcccacttcttaatggggttgtttgcttatttcttgtaaatttgtttgagttctttgtagattctggatattagccctttgtcagatgagtagattgcaaaaattttctcccattctgtaggtggcctgtttgctctgatggtagtttcttttgctgtgcagaagctcttgagtttaattagatcccatttgtcaattttggcttttgttgccattgtttttggtgttctagacatgaagtcctttcccatgcctatgtcctgaatggtattgcctaggttttcttctagggtttttatggttttaggtctaacatttaagtctttaacccatcttgaattcatttttgtataatgtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtatcagtaccatgctgttttggttactgtagccttgtagtatagtttgaagtcaggtagcgtgatgcctccagctttgttcttttggcttaggattgacttggcagtgcaggctcttttttggttccatatgaactttaaagtagttttttccaattctgtgaagaaagtcattggtagcttgatggggatggcattgaatctataaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaaggtggattcctaggtattttattctctttgaagcaaatgtgaatggtagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttatttccttctcctgtctaattgccctggccagaacttccaacactatgttgaataggagtggtgagagagggcatccctgtcttgtgccagttttcaaagggagtgcttccagtttttgtccattcagtatgatattggctgtgggtttgtcatagatagctcttattattttgagatatgtcccatcaatacctaatttattgagagtttttagcatgaagcgttgttgaattttgtcaaaggccttttctgcatctactgagataatcatgaagaaactcactttaaatagaagaatattggtccattaaaagtagaaaatggcaaaagacataccatgcaaacactaatcaaaaggaagttagagtggatatattagtaacagaaaattagacttcaggttaaagaaaatgattagagctaaagaggaatactacataatgacaaaagagctaagtcaccaagaataacaaataattctaattgtatatgcacctaacaacggaggttcagaatacctgaagcaaaaattggcagaaaggaaaggaaaaatagataatccacaattatacttcgcaagcgtgacactactctctcaacatttgatagaaatgctggacataaaatcagggatatagaagaactgacaatctgattaatatttataaaacatgctctccaacaataacaccatccacattcttttcaagtgtacatggaacattcaacaagatagaccatattctgggtcataaaaccttaatgaattttaaaaaattgaaatcacacaaattatattcttgaaccataatggaattaaattttagaaatcaataaaagagtgataacaggaaaatcttcaagtacttggaaattaaacagcacacttctcaataagttatgggtcaaagaagaggtattaaggaagattggaaagtattttgaactgggtgaaaatgaaaatatcagacagtgaaaaacacaatatatactgtgatgtgtactgtaatacaaagtaggtcaattaccgatgctcatttattcatcatgaacacacaaaatcagtaaaatactcaaataacaagttttaaggtattggtatattcacccagttgataaaaatcagccagttaatttgacagataagtattaaataatcaggctgttagaatcaggtgagtaaaggagaaagtaaaaacctgaacaaagtaggatgatgcaggtaaagcaatgcttagaggaaaattgatagtattaaatgtttatatgaggagaaaagaaagatctcaagtaaataccctgagtttgcaccttaaaaaatagaaaaagaagagtaaaagccaaagcaagcagaggggaggaaatggtaaagatgagaccagaaagcaatgaaattgaacacaggaaaatagagaaaatcaatgaaactaaaatctgtatttggaaagatcaataaaattgataagcctctagcaaggctgacaaagataagaagagagaagatacaaatcagcaatatccagaattctagacccccatggacttcttttaaaaataataagggaatactccacatatttgacaatttaaacataatggatcaattccttgaaaaccataaaccctaaaactcatccaagatggaacagataacctcagtagtccaatattatgtctatgaaagaaattgtatttatagttaagaagaaagcaaaagagaataacattggaggaatcaatacatagctttaatacttactacaaagctacagtaatcaagacagtgtggaactggcaaaataatagacacgtagaccaatggaagagaatagactcacaagtgtggccattttatttttagcaaacatgcaaaagcaatttaatggagaaggggtagtcctttcaacaagtgatgatggaaaaagtggatatccatatgcagagaaaaatgaaccttgacctaaagctcataccttatacaaaaattaactccaaatatatcgtaggtgtaaatgtaaaactataaaactttaaagaagtaatgcataagagaaaatcttcatgacctagggttaggcaaagtgttcttagacatgaaactaaaattgtgatccataaaagaaaaatgttgatcacctggacttcatcaaaattaaaaacctttgatctgcaaaagacactgttaaggcaatgactgccacagactgggagaaaatgttttcaaattacatatctaacaaaggtcctgtatccagtatatataaagaactctcaaaactcaacagtaaaacaagcaatccaatttaaaaaaaaacaaaagacttgaatagattcttcaccataggaaatataaggatgacaaacatgtgaaaagatgtttaacatcactagcatcagggagatgcagattaaaaccttgacaaaggctgggtacagtggctcacacctgtaaccccaacactttaggaggttgaggctgcagtgagcagtgactgtgccactgcactctagcctgggtgacagagtaagaccctgcctcaaaaattaaaaaataaataaaaataaaactgtgaaaaagatacggctccacacctattagaatggctaaaatacaaaatactgacaataccaaaagctggcgcagatgcaaaacaacaggagccctcatatgttgctggtgggaatgtaaagtggtatcacaaccccagaaaaggttgacacttgcttataaagagtaatatacacttaacatatgatccagcagtcctgttcctgtgtatttaccctaaagaagtacaaatttatgttcatacaaatacctgaattcatatatgaatgtttatagtagctgaattcataatagcctaaaactggaaacaactgtaaagaaactgtagtactttcctaccatggaatattgctcagcaatataaaggaaggtactactgatacacccaacatcttggatgaatagcagaggcattatgctgagtggataagccaagactcaagggtacattctgtatgattccatttcttgaaaataaactataatgatgtagagaacagaagagtggttgtcatgggttagagaatggtgtgaatacaaaggggcagcatgaaggggtgtttgaagcatggtgggactattcttcagcctgattgtggtgtgttacgtgtgtttaaaaagtcgtggtaaggccaggtgtggtggctcacacctgtaatcccagcactttgggaggccgaggcgggcagatcacctgaggtcggtagttcaagaccagcctggccaacatggtgaaaccctgtctctactaaaaaacataaaaaattagctgggcatggtggtgggcacctgtaatcccagctacttgggaagctaaggcaggagaatcgcttaaacccgggagatggaggttgcagtgagctgagattgtgccattgcactccagcctgggcagcaagagcaaaactctgtctcaaaaaaaaacaaaaaaaaaacagtcatggtaagccgggcgtggtggctcacacctgttatcccagcatcttggtaggccgaggcaggcggatcacccaagatcgggagttcgagaccaacgtggccaacatagcaaaaccccatctctattaaaaatacagaaattagccaggcgtggtggcatgcgtgtgtaatccgagctacttgggaagctgaggcaggagaatcacttgaacccaggaggcggaggttgcagtgagccaagatcgtaccattgccctccagcctgggtgaaaagaatgaaactccatctcaaaaaataataataattttttaaaaaaagtcatggcatgactttttagccaggcacactagcatgtgcctttaatctcagctcctcgtgaggctgaggcgggaggatcgcttgagaccagcctgggcaacatagtgagaccctgtctcaaaaaaattttaaaaaaatcgtggaactgtaccccaccagtcagttttactatgcaataatttttaaagtaagattttttttaatagaatttctgtggcctgataagatataattctgctttaagaacttctgtgaatgtccaacattgagatcatcacaaggtaattcccaaaactgccacactgaagacaaggcacacctaaataaatgtcactgggagcccctgctaaactttttggccaggaatccataccaaggaacaagtatccaactatgacaaaggaacaaaacattcatattctctttgctaaagcacatttgtgaaagtaaaacatctccccccacccccgcaaaaaaaaaaaaaggaaagtcattcctaaaaattgatagaatagatttggacatcagagtgtcaggccactcatgcaagttctagcccttcaaataagaatgtaaagccgtaataacatgacagcattttgaataggaaaatctggatttgtgaagcagtgtgtgtttttgacaacagtagttccgcattcttttatgcaacataaacatcgatttgtttaaagttaccattcttttatttatccagcgggagcatagatagcatcatagggaaaaagagactctatcctgatttgttttctctttatttcactacagccagcattctggaacccctttcaaacatcccttcctgtgggttaagggagattatttaaaaacaaacagaccacacaaaaaaacagcacagtttctaaatttttgtaataataattgaaaatgtaaattagtttcaatcaagttccttttgttctcctggtttaaaattactggttaaggttattttgcattcacaaatgttaaacagtatatctgagcaaggtgaaatagattacagaggagtcatattggcgggtgggacctccttacaggcctgcagatgactgaaggctcatactgcctccagtggcttctgcttaagccccacccacctattacaattctgaaggggaacagtattccaataaagatattttctttcctattattttattttttaatggctgtgattgtataccatttcatattaggcttagcaaattcacatactcatcttcacttgatgatctaccaatttgctcttttcatttcttcacaaaattaactggcctgtgttgaagagcataaatctctagttcctaaattcttgatacactttgtggaatttttttactagcattaaaaagtgtttgaagctgcattctgtggatgaggccccaggctctatccaaagatatccctggagtatttctctttttatttgttttatatatgaagttgctctataaaagtttatctaaaagaaaaggggttccattaccaagaaaatattgtgaacgccactcacctggacaaatgaaattcacagataatgagaacttgagtttttaaccagtcatccccatttcccatccctctaaactttaagtgttgctaacagcaaaatttgactgatttcatgctttatttgtcaacattggaatagtgtttattgaataccttctatatgccagtaccatatttcaggggggtgcattactttatcttactttgcctttggaaaaactgctgagaagtgaagtggctaaggcagaaaaggggaagaatgaggacatggattatctgtctcagagtaattgagtgccacggtgtgtactgactaatgtgccagaccttcaaatgagataaatgggcggtaaaaagtgatttcagagaaacagacctgctagagctcagattgaggcacttctgttatagtcatagaagattacagaacaattagagccaagaggattgcagaagaaacaaaacactttcatgttaacacagcctgccaaggaatcagataagatattggcataacataggcttgggaattgaagaattcctatgttgttgatccttgaaccttctgttcaaatcccagatagagggcaatagataggtaagacagaaaatttacagtggaatggcatctaaatatgttgaggctagaatgaagcctattacaagaacctgagaactttttttttcttttttcttttttttttttttgaggcagtctcgctgtgtcgctcaggctagagtgcagtggcacgatcttggctcactgcaacctccgtctccaggttcaagcaattctcctgcctcagcttcctgagtagctgggattacagatttgcactactacgcctggctaatttttgtattattagtagacagggtttcaccatgttggccaggctggtctcgaactcctgaccgcaggtgatccaccctcctcagcctcccaaagtgctgggattacaggcgtgagccaccgcgcccggccactgagaacaatttttaaaagaggacagagaacatcaatgggatgtattatcaaaggacttcccatactttgagacctagactggggagatgtatagcgtgggaaggatttttgttttgtttttctgatttttccaaacaatttttttgagttgcaaaagcttaagataaaagttacaggaattgagtgtttcctttctttaggtgaaagtagttgagagagaacacatttatggctatgcattttattccaaggaaaatccattagccaatttgttttttgtattttttaaatacttctttgtagaatagtttcgttttctatcgcatgtagaaagcagcctaggtaagctttcagtgggaaagaccagatcttgtatacaagcaaatctagtttctaattaaacaagtttctaacactttaatgtctaaaaagaaaaggcaggctgggcatggtggctcacgcctataatcccagcactttgggaggctgaggcgggtggatcacttgcgagaccagcctggccaacatggtgaaaccccgtctctactaaaaatagaaaaattagctgggcatggtgatgcatgcctgtaatcccagctactcgggaagctgaggcaggagaattgcttgaacctgggaggttgcagtgagccgagattgcaccactgcactccagcctgagtgacagagtgagactccatctgaaagaaaaaaaaaaaaaaggcaaaaagcagccaagtcatctttttgttggctctgtttttgcagtgccattattgtcctggcaaattggaagaatttagacaaggaattagtgaattacacatgcatgtgtgttaataccctttcttttattactttttctttggtttttgaaatttaatttgctgacatttgaaaatatacctacaattacttgttactgaataactacttattcaaaatatcatggaggaaaatcacaagacctctaccgtgattcagtaactaaattatgttaatagctacctgaaatttcctaaagaaagtccaaaccaatggactccactaaatgatctcttagagaattactgcttatctctcattatgatggctggttaggatagagagtctgtgtcctcagagcctagcagccatgtttaggggtgggctgtatgaatatatttcattgactgagctggctagaacaggataatggccaaatgtagtctgaccagtagaaatgaacattgacaagaattaagtcttaatgaaataggaggatatagttaatgtgaattgagggcttaccatgtgccagacagtagacttttgccaaacactttatatgcattgtcttatttaatctttacgacattctgatgggtattttacagctgggtaaaccaaggcttcgagaggttaagtgacttggtagaaccagaatttgaagcagtctgtccgactctggaagccacacaattaactactattttatatctattatcattatacctgttatcattaatgtgagaccaaatgataccaaaaagcaaagtttgaggatggtgagcaaagacctctccaaaatctacctctacactttctgctgaaggatagctgatacacaccccacccatcaccaccaaaaaaaaaaaaaaagcacaccatttctcgaatattcctaagcatcatttttgaaaatttcattgttatgtatatgaatctatgctgttctctgaaactattagtcactaaaactacattcatagatataatttgtttcatagtagcttataagggatataacctcattatagactgacaaacactctagaacaaagcagagacagtagagatacattaaaggtttgttgtagccaaatttaaccccccaaaaaagatttaaagcaaacatataccagctactatgtttcaggcactgttctaagcattttttctatttaaactcatttaatatgcatcataatcctatgaggtactgttgttattcctgctttacagatgaggaaacatggttagatgctgtctttatttacttcacattactattaatatgaaagaatacctgagtctgggtgatttattaaaaaaagaggtttatttgacttgtgattctgatgtctggagaacttcaagacaagattggacatttgtatcagatgagggcctcgggctgcttcctctcatgggggaagatgaaggagagctggctgtgtagagatcgcatggtgagagaagaagtgagagacagaggaggggaggtgtgaggctctttttaacaaccagctctaaagggaattaatagagtaagaactcacttagccactccttcccttagggagggcagtaatctgttcatgagagatctactgccgtgatcaaaacacctcccattaggtccttcctccaacattggggatcacatttcaacatgagatttggaggagacaaacatccaaattatagcagatatcttgcccaagaccacccatttaattaagaagtagagccaggatttgaacccagtctggttccacagtgtgtgctcttaaccaccacactatacttgtctcatttcgtatttttacatgtagtagtttaaaataccttggctttacttagctcctttcttctaaagaacgtattcttctagcctcctgattctctctatgccagattaagttcttgcaagtgtctctttatctcgggaaacttcccaaagacaaatattcatagctaataaatagttataatactcactgccatttacttagcactaattttatgccagataccgtactgtttcctatacattatctcattcagtcttcgtaacagtgccttgaggtcatgttcccccccaccaccaccatttacaaatgaaaggttacctggcctctctgagcctcagtttttccatttgtaaaactgagaaagcctcttgatgttctgttaggaatttctaaaggcaaatgaacacgtattcaagtatatacatagactgtggaacataaattttacttctaggaactcaaattttgacatctttatatttcaatttttattttaagttctaggatacatgtacaggatgtgcaagtttgttacatgggtaaatgtgtgccatggtggtttgctgcacctatcaacccatcacctaggtattaagcccaacacgcactagctattttcctaatgctctccctccccagtttttttttttgtttttttttttgtttttttttttgttttgtttttctgtttttttttttttttttttgagacagagtctcactctgtcgcccaggctggagtgcagtgtcacgatctcagctcactacagtctccacctcccagattcaactgattctcctgcctcagcctcccaagtagctgggactacaggtgtgtgccaccacacccggctaatttttgtatttttagtagagacggggttttgccatgttggccaggctggtctcaaactcctgacctcagatgatcctcccgccttggcctcccaaagtgctgggattacaggcatgagtcaccgagcctggccaccccctcaccccccacaaattttgacatatttttaatcaaaggtgcaatttctaaaggtgcttctcagaatgaagagcaaaaattataaaattaagttgacacattagacgttgggtccctagcacaacaatggtacacattggaaagcttgtctatttggcttggtcagtttctcattgcagcctttgcctctagcccgcaggcccatgaccttttttgtggccctgtgcttcagccacttggacctatagtgaactataacctgaatgtgacatcattgtagcctgtgtgagggaggtaccaggtgcatatgaatggaccgtctctggcacacaaagcaagtatgtcagattgaaaactggccacaaaagaactgattaacacagaatgacatagttgaaaatgcatcaataaaaagtggcataataaaaggatcaaggggcttggacactgaaaacctggcatcaagtattggctctgccacttactagctgcatgacctaaggcaagcccagtaacctctttgagtctcagctttcttatatgtaaaatgaggataatcagaataggtagctcacatgttgaggatcaaatgggagaaaccataatgcaaaggagagtgctctgaaaactagaaagtgtcaaattgacattaatctatcatgctgaacttcattaagcccctcctttggcatactgtgatttaatccatatatagcgtgcatatatggactttattttatcttgctcaatcctagaccagcatttcatgccaagaagtgagatgatgtttggaaataaaaatatgccgccttctcgattctagctatgaataatcattctagttttgactctaccagtttttctaagaggtttcaaacaaaccatagctaccccatttactgaccagatctagtattataaacagatgacttcaccttgatgaactttgtaaaataagggaaataatcccagtttcccctgacctcacagagttattctgaggattgaatgctttgaaaaatatcacatactatgcaagtgcaagggttgtgaattttttttattgtttagcagagtaattcatttagttattgaacaggcatattgataaaaatattgtcaggaataaaaaaatgaatatgaccatcaaagacctctcagtgtagcatcggaactaaaacacacaaataattctattagaaaatgaaaagtgatacatgccattaaaaattatagaaagacagtggttgacatgaagagaggggtatataaatggaaatatccacatttaactgtgtcacagtattggagaagatgtacccacaccatactgtaagcttctgcaatctttcagtatttttctcttgtcccctgatgtagccctagcagctagaacagtgccttcgcatgtagtagattctcagtatgttagataaatgaatagttgtctttctgatgaatacaggtggctcatgctatgagagtaggctgactttaacttaccctacgtttccatatgaagcagaacttcttcagaggtgtcacctaacccagaatgcaccttaacatccagatcaaattaaaaggttaagttttcatcctgatgttactccaatgtatttatagtagccatgtatatttattttagtcattgttgatatttgtttatcacagcaccaagggaccagttattaagatatttgaaagctgaccaaacattccagatgtcagttttgccttttgtgtgtgtgtgtgtgatgggggtggaatgggaaataatagagaatttttattttaacaagataatgtgccagggaagaggaacaagtggctttttttggccaataagaagacaaagtcatattgcagtttttcatccagcttagatctgaaaagaaatcctagaaattactgaatcgaagaaaaccccccctttttttgagacaggatctgtttgtgtcacccacattggagtatagtggcgtgaacatagctcactgcagcctcaaattcctggactcaaggaggtcctcctgcctcagcctcccaagtagctgggactacagacatgcgctatcatacccaactagtttatttttttttttttgtagagatagggtcttgctatgtaacccaggctggtcccaaactcttggcctcaagtgacctctcccccgcccaccttggcctcccaaagcactacaattacaggcttgagccactgttcctggccccattttttccaaataagatttcatgcagaattcccatctatgaaacagataaatatttttatcaatatagatgtctattttaactttgttttttacaagtctgtcagtgagagcaccagttaatacattggggtcttaaaggtcttaaaagttggtatgtagcacatgtgagtgaaccttttaaattttttgatgaatatatactttaataaatgaagaagcccctgaggcccacaaatagtacatatttgaacaacactaatctagccctatccattcataccatagatagggagtttgaaactaatctgtagaacctcattctaccactacattttactttgtgatgtggtactattaataaatctgaacttggcccactatctcagcactttgaggttttaagggtgtctccagcttaagcatcaataaacatttctagaccatcttaaagttccagtggaatccaagggtatgacttacaaaccttgatttttatgttattgtttcttctggtttgaaatttatatttaaattttcattgaggtattgatacatgcttacatgtaagagagggcaaattcaatctttttttgacattaggttaacctagaaataatgacattaaggaaaccttttgtagggaggacagtaaacagtcctcagtcccagtgaggaccccatggccaatatttggatatttcaacatctgcagtattgaagccagccgtgtctcctcagatggaaattgccatgtgcagaatgacttgatagaaaatggtgtacattctatataatcttctaacagcagaatgcgaccagtggcacttcccctaaaaaaaataaattacccgaaatttgcagcacattcatattcaatttcatcacagcagatgctcattagtatgttgttattaattggtattcactttaggttttgtttaaaatgaagataataattaggttttaattactgcatcattcgtgggggtgggggttgtctgtggggagagggaaagagtgaaatgcctcttaaagcactaaaatatttcctgatgcttattcagcaacgtgtgttgccaaagactttgaaaaataacttcatctttacaaaaaaaggattctgaaatgaagaaattactgtgtgttttttaagcccatcgttatcaagaacttgctgtaaattgtctacttgatggacatactgaatcagatgataatgtgcaccaccattctttctaatcaaattaccaaaaagacttcttggaaaagtaaccctcacaagcggctgattaatgaagtggtggcaatgttttgtattagaactaattgaagtaatccaaataagttatttctgtagcctatggaaataatttcctttgcaaagaagtacagtggagttggcaaaccagtatttttttttcaccctctgttgttccacatttgcaaaatagctaagttaacatagatattgcaaataaaatagatagaaaactaagtaattgagtggcagggaaaacaggaaagtttatttcaaccttttcataatcaagacgaataatttacctaaagcctaaaggtgtatggaaattgagcgatactggaattcgaaggcatatctttagtaaaatgctgtagaaatagcagtttttaatgcattcatttaaaagagacactcatgttcaagagtttagacatgttccttagacaaaactttctggagaacctgtggctggcatggcattgtgtttggtgcacaaatcaaaccctccagaagcttatcgtctaattgggaaacgtataggatctatcacatatccactgtgtacttcgtagcagtcatggtgctcggtgctttttgtatggtatcttgttattttaacaacattcctgagacacgttagtcttgttttacagatggagaaattgaggtgtgaatatgttaagcagtttgtcaaaggtcacccaagcctttagtggtagaactacatttcaagccagattcagtctgaccccaaagcctatggtctttctgctattccagtcttccatggggatatacacataggacacattagaaatcaattcaaaggactagtgttgtatcattaagcaatatgcatgtggtccccgccctcagcagctcacatcctaggaggctcaaggggtgataaaaccagtgaggactacctggggtgggagctgtaggtcagagggtgtagtgagccatgtggtcacaggataggcaactatgtctgtcaggtggaaagtgaacagacagaattatggaggcacaaacggcttcccgaagatgatgatgactgtggggtctgatgaggtggataggaactgactggatctttaatcaagaccagaaggatagacctgaaaggggtggaattgcttgggtaagggtgtggaggaaggaaggatacatttcctgactgtagcaggggatggtgataagggtggcgtgggtatatggccaggctggcagttgaggggcatgtagaaaacttgtgagagtggacctgaagggttggaactttatcctgtgtgtggtgagggtgctagtagggatttttcagcaaagactatcctaagctggattttcatttctagacatgtacctcatgatctctgtcagtgctagtgaggtttagagttctgaatctgctatatggtatgatacctagatttaactgtatcttcaccatttgcaaagtaatgcagtttaatacaccttcattatattttacagttatagcgagtgctggattatctatgcttctactagaacgtggtgtttgggggtacgttttgggttttttggcagctgattttccttcatgatttgatatttttcaggcttcaccaaaatgaattttacatcaatgagaatgtaccagttgatgatgcaaggaggcaggccttgcatcttctgggttgtatgagggtgataacttgagattaagattttgctgtggataatctctaaggtcatgagcccaactcttcatacctcaaggaatttaattcagggacaagttgtgttatgagatgactttagctaatttctgctgtccctacaaatgagagagaaaagactggttatgttcccatgcaaatatcttagaaatataaagtaaaagactgtcttgtcaaaccagttcaaaagaaagtcagatgaaatcgatacctcagaaaacagtttggcagtacctactaaagctgaacatttgcatgccctatgactcagcatttcccctcctccaaactgtaatcaacagaaaatgatacatattaatatgtgcttcaaagacatgtacaggaatattcacagtagcatcattccgtttgtttgtttgtttgtttgtttgttttgagatggagtcttgctctgttgcccaggctggagtgcagtggcatgagtgagctcagctcactacaacgtccacctcctgggttcaagcgtttctgctgcctccggagtagctgggactcacaacaatgagaagaaatgcgtgactgctacacaggacaacatagatgaatctcacaaacacaatattgagaaaaagaaggctgggtgtgatggctgaggagttcgagaccagcctgagcaatatagcaagacctcatctctactaaaagtttttttttttttttagttagctgggtgtggtggcacgcgcctgtggtgccagctacatgggaggcttaggtgggaggattgcttgagcccaggagttcaaggctgcaatgagctatgattgcgccactgcattccagcatgggcaacagagtgagaccctgtctcacaataaataaaataaaaatagaaagaaaccaaatagaaaagaacacaaactgtacgactgcatgcacataaagtttaaaggcaaatctattgttagctttaaggggaagatggggaataattaggggaataaggggggcctctgggatactaaaaatgttgtttcttgctctgcgtactgatcacagagatgtgttcattttgtgcatcaagccgtacacctagtatttgtgtacttcttgtgtttttattataattcagtaaaaatttaggaccaaaaaaatgcaagtcagctttaacactgccctgtattttatgtaacagaaaatatatcctatcctaatcttgaaataacttgcttaaacaagcaagcatcttcctcagaaatgattctcatgaaaacttctcagcctattttggataacataaattccttgatcttgagccagattagaaggatcagagtctatggttctaaaagtatccccgatacaggtagtgtgtagcacagcagttctcatctcagactgcccactagaactacctggcagccctttaaaatgctcatatccagcactccactctatactctcatttagttgttctggggctgaggtctgatcatcagtactttttttttttttgagatggagcctcactcttttgcccaggctggagtgccgtggcgtgatctcggctcactgcaacctccacctcccaggttcaagtgattctcccacctcagcgtcccaagtagctgggactacagccatgcgccaccacacccagctaatttttgtatttttttttttagtagagacggggtttcaccatattggccaggctggtctcgaactcctgacctcaagtgatctgccctcctatgcctcccaaagtgctgggattacaggtgtgagccaccacacccagctatcagtactttttttaaagctcttggggtgactggtttgcagccaggtaagggaccactgatataggacctcatcagaaatctcaggagagagactggataatattgataaatggattcaggactatgttttggtcataaagtactttgacttggagaaagaatgaagtttgcgttgtttctaatataatctgattacaggattcaaaaagaacacataaaaaacggtggtattaaagcattttccttttcccttcatttcttcaacaatatttgccaagtcgtcccctgtgccaggtatcaaaacagagttctttccttacccctgtgtgtatatggacctatgagtgcacccgtggcccacccttattactctggtaacactccaagtaactaacttgaatgcagagcgtgatacatacagtagctatttcagctcagtattgtccttaccaaatcacagtcggccactttggtacatgatgttctaactataaaggaagactgaaagaagcctaggcactgtgttgagtgcaattttcaaggaaagagcaagaaatcgaacattttaaaccaataagtgaaagctggagagagaaagaaatgttaaaatatcatcttattttcttgaagtattttccatccaatcttgtacagtcaaaatgagcatttaagtgtgaggaaaaaaacgctgaagatctcagataagactagagagtgtcaggtttcttgattagaagaatttatcatcaaaggcaaaagagaaaagatggtaaagattttttaaaaaacaaaaaatctccaagggatcacaaattagtggtgcaaaatcaagacaacaaaagtaggtgttattcttgttcatttaaactatagttttctctgtttcatgtgtgttttttaaaaccacttaattgtatttgacattgaaaatgtaatagggccttttgttttcaaccagtttactaattgcaaaatatgtcaggaatcaaaagggcaggaggtgttggtatatttttttaaaatatataactcctttttaattttttcccctattttccttatccatttaggcagtgactttcaattagcctgcctactaatatcaggtcactaaactccgtggctgacgctttattccttcatgtgggttgtcactcgtttgcttcagttggctggcaaaggttgttgtatatccattactagcaacacagcactttgcatttctgaattgacaagcagctatattgacccagcgcttattatgggtcaacagctgcgttaaccaacggaaggactgaggggcaattaaaatgaattggcaaaaatatatcttcctaatttactccaatttgttatttatgctaacattgtatggcttctatggtgacactaaacagaatggacccaataatggcaattaacataaaaatataatggctaatcaaattgacagcaactgtttctcatcatctcgacacacaatacattatcaaaacaaactattatgaaggaggtaatttcagtgttctattcaacctgcagcatgtgtgcagtcagggagatgtgtaccagcaattactgctgaatctaaaaaactaaacaaataacttaatcgctgtcgtcctccttttttttcccccaggaagcagtaatcaggattcgctaaaaataactggtgtataatagtataatgatgatgcatattgtagaatagctaataagaaataaaataggcttctaggtgtatactttttaaagtaggttcaggtaaagaaagagagacttgtggaaggaatgcgcccacaaaaaagacaatagccctgaccgataaattgctccatgtgggtttgttcctgctaccgaatatttatagataccatttgtaatggccaaagaagtataaaatacactaaatttagtaacacattttataagggaatgagcagaaaggtgaagtgtgagctctaataactgaattttagttactcctgcaccaaattgggttggctataatttttcatcattaagacccagctaggatccttggatctaatacttggttactcaaagagattccctttgaaaatagtgctatttccatatccagttgtagatagtggttttccttaatttcttatttacatgatagtctgtgtgtgccacctggccttgctgcatggattgtacaaatgacttggctgttgtggtcattcataaattcattcattcaaccaacttggcacacagtgggtgttcagtgttggttaaattacatgtcattccaaggcagcaagggagaaactggtaacatgtttgtcatttgatcttctcatttgaaaagttctgagggcttagttgtttcaccttggtaggacccctcaaagaaaacaccaaagcttgagctcattgttccccagctcgcaagtttcccaagtgtctaaccccttgggaagatggaaagaaagtttgtaggtcagttgatttaaaatagatagaagtgcatttgaatgtgactccccaaataattctcatattggttattgaattgactgcatgtatttttttcccacacagagtgagacacagttgcttagaatacacagtgactctaaataacctcaggaatgtttagtatatgtttgctgagtgaatagtagttcagacacgtctcctacactttgttgaattggaacttggcaaggtcattaaacgagtgttttgacatgggtgggatgaaaagccttggttatttcatttcacatggtacttctcagagatcatacgttgcccacttaggattaccacagagcaaatagtcaagatgttactgtgagtctgtgagccaatcctggcacaggcaatggattgtcaccacaaatcataaaacggggctcatggtatagcaatatgtattaaacagttttcagaatttgtttaacttcctgctagcatggacagggcccagttaggaagcacatagcacttttcccaattaacagtgcaaattgtcatgagtgcataggaatttgcagtttgacaaaatcaggtttttgacagcaggggtaatcagtctgcagcttcgcaagtagtaatctatgatcgaagtggcaggatttattctgaattatgaaaggtgtatatgctatataagagggacaaaccattagtatgattctgcccttcttacccactttctttaaaaaatgctgcttgatttggaagttgaaagtaggggatacactctgctgagagtgatccccatcgcttccccctccccagtagtagtattcatttattttctgttatattacagtattctgacaagtccctgtacacccagctgtgcttttaccggtacatttttgatgcggagtgtgcactggagaaacttactaccgatcatgagaaaggtacgttaaaatactgtaattacctttgagtttaaagtggaaatttgcattataaaagccagacctactgtgtcaggctgttcatgcagcatcacattgctgtctcagaagcaggccgtgggggcctatgtgaacacagggatcccctgcatgaggggcggtggcataggaatccccagctttggcccccacagcctgtttcacattgtcctctattaaagcaaggctttgggggaggaacagtacaaaaaggactctttaaatgctatattttgaaaatgctattttctacagagtttagtaactgtaataaagtaagcataggcaacgtgatcattgggcctacaaaaaccagatattactgcaaaaaaatagacttggagtgtgtctctgctgttcgctaaaagcctgggttcgttttgagagagggatgaggtggagttcctttattgactccatcctaagagagtatataggcgcctcagcccgtatgatcagctgttgcatggaaccctcagcactcggcgtttccttatacaagacttgcgggcactgtgggacttaatgggtctgggaaaagctttgttacataacttaaagtatttgaaaatgtcatgacaactgcatgtttgttttttttttctcctacctgaaaatcacattgacaacttttctattacctgtgaaaaataaaaaaggcagatttatacatttttcttattagttacctacagagtgtttatgttgtttgtcagcgagtatcaattcaacgttttgttggtcggtactagggctggaaacaaccgcaatgacattaaaaacctacaactattgctagatttccccgcataagaatccccatgctgcccttgatttgttctcactgtttttaattccagtcataattgacttgtttttccatccacaagataggctagaaattattttttaaatgccttgacttatttggttttgctgtccttggagagagagcattttacaactgatggagaagctggttcagatattagtatcttatctctagatgttcaacaaggacttgagctatctccacagcatattttccatgaattagtaaaatttatacagagaataaatttattctgcctattaataactaagttttagaacttttattcatggtcaatgtctagcccatatatacttgtaatatcatttacagctgtttttcttttatccccaaggacctttcctaaagacagttatgagttgagaaaattaagtactgattatctgaacgcattatctgtttctatcaggtctgttacctctttctgaatatcagtatattagaacctgttcctctattacttctttttttttttgagacagagtcttgctctgttgcccaggctggagtgcagtggcacggtctcagctcactgcagcctccgccttctgggttgaaatgattctcctgcctcagcctcccaagtagctgggattataggcatgtgccaccacacctggccaatttttgtatttctagtagagagggggtttcaccttgttggccaggctggcctcaaacccctgacctcaggtgatctgcctgcctcagcctcccaaagtgctgggattacaggcgtgagccactgtgcctggccagcccattatttctttctaaatctatccatcctagattgttttctatatgttatttgaggggaaagattcctcttccctatacggctctaaaattcttatctgagaggcagaatcagtcttttatgatcagcagttttcaaaaggtctggcaactcttggaggcatgtagaggagtgatctggaaagtcactggagatttagcccatcctcttagaggacactgagaagtgcacgttattacacccacagaaaataagaggaaataagtagccgcttggaagcctcttgcttggctaaaagggaaaagtattgacaggatctgtacactcagagtttactgtagtcccatttcacaagtttaaggatcagtacacttttttattgtttgtatctaataatatactacccagcaattcggggcaaaaatggcattgagttatcgatgggttcttttatatatcagagggctaaagaaaataagacgagaagagaaaaaaatatatgtgactgaaggaacttcatgaaatgttccaagagcccttttgttttatttattgaattttaccaattgaaactctttgagtttcctgctgtttatttattattcctgaattacagtttgggaatgagtgaattagctgaaatttacatgctccaggcattttcagatcatgcagtaatgctaagtggtattagggtattcataagtggtgggatataaaccaaaacttgggggcacacttaccaagagcagaggtttcctaacacatgacatctgataagccctctcctaagagtcacctggggcatattaaaaacccaaatccatagatcctatgtccacagattctaattcagaagatgttgggggtagagcttaggaagctataattttttgaaaattcccccagataattctgccgtgcagccaagtttgagaacccctctcctgggcactctaaagacatagttggatggtttctaaataaaagacaattgaatgcaaggtcatagttcatagggaacaatgggggaacaagaatattcttatagtagagaggagaacaattataggggaaaacaccataagtttaaaatagtataacaaataaaattgacttctcactttataagttggagtgaattctcttttgatttgctattcaagggagacctgctattaaaatgagtttaaaatctaagggaaccggagggcaaatatatttattcaatttggaccatggccagaacaccagtagatgttaacatcaaaagtcctgtgaaaaatgacagtcgttatacacagttatattattgagaatggagtctaagtgtcttctgtcaacaagtgccccgtaactggtgtgtgaagtatttactgtagactctcctttactgtcagtacctagcaacatttccttcactaagattgttttaccatttccatcataaagcccatattttaagggttgtaactggatggtggttttaatttttgtttgaaacttggcaatttgacttagaaaaacatgtacaaattatttgaaagaggtttatttttatggggaaaagtagctcttgtcaaagctttttctctgctttgctttcaaacgagagtttacagaccattagtccataatgtggattaaccccatttgatattttttccttcctttaaaatggtaaaggactgttattcacgttggtgaagtgtttactgcatatttgctgtaactgcattacatttttaaaatcttatttctgtgggactttggcattattattgtaactgctccagaatgtacacagatggcataatggattcaaaggcggttttacaggaacataggggcaatctatgaagtaaaaatccatttccaggatggccgcatgaaatggtcccatttggctgcctcatcccgtggtgccttggcctgagtaggggtaagtgaacagttcaggggaaacctgaatcagttcaaatctaaatctccttaaaaatgcaggaagaaaaaagtctcttagttttctcaactgaacctttgttgttgtttattcagcaacagtaaaaacaatttgtttatatatagttcctattaggtgttgagtgacattcctcatgtcagaggaacaaaggtggatggccaacactccctgccctggaggagcttagagtctgttgaggaaagacagattcagcaacaactaagtgtggtatggcctgagtgtcaccaccaatagggtgaaattattttggaagcaaagagagggagccactaactgctttttcacttcagtgtttgatctttctttagttctagaaagaaacttttttttctgtttctgttctcatttagtagatgcttctctcctcatattctgtgtcagctattaatagtaagatggtgtattcatttgctaggactgctataacaaagtaccatggatggggtggcttaactatatttcctcacatttctggaggctagaagtctaagagcaaggtgtcagcaaggttggtctctccccaactttttttttgagacggagtctcgctctgtcacccagactcgaatgcagtggtgcgatcttggctcactgcaacctctgcctcctgggttcaagcaattttcctgcctcagcctcctgagtagctgggattacaggtgcacgtcaccacgcccagctaatttttgtatttttagtagagatggggtttcaccatgttggtcaggtgggtctcaaactcctgatttcatgatccagtcgcctcggcctcccaaagtgctgggattacaggcatgagccaccacacccggccaggtctctcctcaacttctagggagctatcttctcccagtgtcttccctctgtacctaatctcctcttcttatactgacactggtcatattggattgggtcccaccctaatgacctcattttaacttaattctttaaaggccttatacagtccattctaatacagtccactccagatacagtctcattctaaggtacaaagggttaagacttcaacctaccttcagtatgaattttgggggggcacaattcagtccataactgatgatctacttgaatttcttaataaattcctttgaacactgccggaattggaacactaggatgtagaattctgttgaagacagaaattggaattgcagcatagaggctagctaaaagatgacaatttacccataggagaagtatccgttggaaagcctgacttcccagtgggggtctctttaggcctagatggactattcttcaggtcaccctgtttctcacaaagtgctatgggcagccttgagtgccccagcctcctgagctgcacctgcaaagattgcagttttcttgctcctctcaaccaggtgaaatcccacattcacttcccctcttgagcctcatatgctttcttttctttttttttccttaaacttttcagtctcttgtcatctcttttcttctgtcttttctttaggcctggtggtaacatctgtaggccctcttgtttcctaacatgccacccagaagaactaggctgccccttttaaggtacttcatagtttcctattgtcctttcacgtgtgtaacacgagttctcacagtactcctgtgaggcagcagtggattgtgctcattatattgatgaagaaattaaagttactaaagttccttgacatttgcagatttaacgcttgtcgcttgaactctttgcaagtgatactgaaggtaggtaacatgttagtgtgtgttattttgctgatgccagatttaaattgaactgaaagaatatccagtcacttaactaatgagcaagccaagcctactgctcctcacccacactgccacggggtcctgttctgtgttccccatcagctaagtagttacactcatgaagtgctaatagttatattactttgtggaaaatggtctccaaaacaaagacaacagctagtactgaaaagggtcttaaaaggtagtattttttaagccagaaaataagagttttatagaagaaattatatgctttagtgtatatgggaatgtggagattttggaaagtctcaagatgggtcccatttcagtgttaaggatttccgctatatttcctgaactgttaaagtgaaagcaggaaagtttcatcatgaaagtagcaaagagcccctgtggtcctctctaagctagttgacatccttagaatttacttggttaaatccttaacaaaatattaaaaagaagactgtgtcagagagcacctgtctggtccttttcttcttattgccactttttgaagcccactggttgtgttctgttttttggtttttttttgagacggagtctcactctgtcgcccaggctagagtgcagtggtgtgatcttggctcactacaagctctgcctcctgggttcacgccattctcctgcctcagcctcccgagtagctgggactacaggcatctgccaccacgcccggctaattttttgtgtttttagtagagatggggtttcaccgcgttagtcaggatggtcttgatctcctgaccttgtgatccacccgcctcggcctcccaaagtgctgggattacaggcgtgagccaccgtgcccggcctggttgtgttattccatcgaaaaactgttgctgaattttgagggcaagctttttctgtttttaataagtaataacaggtaaagcacacacaaaacagttcgcatctattcattcttcttaaaattatattttttatatttgtgcaattttctttagaaaaatagattttaagatgggtaactgtaaactgcatttttaatttcattttcttacaaataaaaaaatgatctgagggtttttaaaaattgtttctttgattaagggaatttttatggtaggaagctctgacttgacagttcagaacatagctgtctgtttattataaagaagtgattgtagaaatacgtaaagaattttggtaagaaaaaagtggtttatataatcttgagcctctgggggttgttattgttagatattacataggtttaatctttaatgacatatataatgataaaatacaaaactagataacttatgattctaatttgtggtgtatatgcaaggtagaaaaattagtaaggaacactagaatttgttatagttatctctaggtggattatagcttttctttttctttataattttatatattttctacattatgtactctgagcatgtactgctctcataacatgaaaaaaattataagcactaaaatgttatagagaatgttactcaacttgaagtaattacccaaataatttcacaattgagggaaaaaataacatagaaatgaacccaaaccagctttttttctccgtgtatttttttccaagtcaaacctaaggccttgttactccaagtgtgatcagtaacccagcagcataggcatcacgtggaagcttgttagaaatgcacaatatcagacccacccctgacctactgcatcagcatctgcattttaacaagatcctcaggtgattcctccgcgtgttaaagtttcagaagcactgatctaagacactctcccttaataactaaagcctacttctattttattcattcattgattagggccgtccttttggtaaaactttaaaacaacaactatgcaggctacagaaggactacccaagttttaaggtagaattcatatcacaacctggccttttgaaatatgtttttattaagctaaaaatgcagtggtctgacaagggctaagagaggggaaaaaagccaaaaagcatgagttcttccactttgtttcttcgtaactagaaggaacaagggagaagtaaattaggattttcaaaatagctttcagctttttaagattagtggcttataaaagaaagaactaaggccgggcacagtggctcacgcctgtaatcccagcactttgggagcactttggcaggtggatcacctgaggccaggagtttgagaccagcctgatcaacatggtgaaacctccgtctctattaaaagtaaaaaaattagccaggcatggtggcacgtgcctgtaatcccagctacttgggaggctgaggcaggagaatcgcttgaaccctggaggtggaggttgcagtgagccgagatcgcaccatagcactccagcctgggccacagagtgagactccatctcaataaaaaaagaactggagtgtagttctacacccacttcgtgtaagggccactctctatgtgcccagagtaaagtttcaccctatcactacattctggacctcattacaacattgatttagtagtattttataaagatttcaaggcattcaactagattcttttaatggaaacaagattctatttcttaaattttgctactgaaaagtttattttgaaattttctttttcctactgtcactgacttttctgtgatgtttttatactcactacaagaacgagaaagttggtattgtctgatggcagcatgcagcctgctaacactggtttatttttctctatggatactgcctgttttgtttttgttttaacttgagataactttacaatgtgacagaagagaaactacattttccaagaaatggtcactttagttgctttccccataagtagaagtgtcttggctctgtacattttctgccatcttcttcaagatagctaagttagtatatgaaagttgccatattttggagcagccagcttccagattctaattatgtgtctttaagcccatttctgtaaatatgcactcaacgtttgcacttttatgtacaaagagacttagaggctttctatgataacagatgtgttactcgttctataaaatcatttcgcattatgtctttttagtgggcaagttcctttccccttttatagtgacaggtacagcaacacaagggctctgccatgtctaggtgataatgtggttgatggtctgcatttgcaaagcatattgtcattttttagtaggaaaaatactaaagattgataagtttttttatgtacttcttaaaaatatgcttctatcaccaatgatgaaaaaaatgaaacaattcgcaagcagttaagccataatgtgagctaatcactttattttgaagaaaagtatttttaaacagttgagctagtgaatttacttttaaaatgtattgtgcttacacagtagatggttttatttccatgatgttttttactacataattatacatcttaattacgtaattactatcataattattatgtaattgcatgtacttccactaattacaaaatcaggaagtgtaattatctagtaaaaactttatgaaatttcatgcactaaaagttagttaaaaggctattccagtggtctagtggaaggctttccatggttagtcttcttagtcataactttagtttagagctggaactcataggccaggacaaggataagtgccaacagaccaacactaaactgagtattgtggtatgggtaagatagactttgtcccttgtgatttaaaaagtcagagagcattttaatttttttgtgactatggagtgtggtaagaataatatctaaatgtttgaggtaggtaccacaaaaactgtcaatggaaagggcagttctttcttaggaaggaattgattaatagaatcaacaaggcatttaggttacacaacagcaaggtcttctataattctgtaatgtgaatggcttatttaatagctatctctgcctttaaaagcaataatgatattcagttttctgtttcttcagtttggagaaggtgtttttccagtttgtgtttatatttactaagatatgagcaaacgtatcaagagagcatactcctttctactacttgatgtcaaaagcagcttttgagacataaacataagcgcacaaacatgtaacatcagaccctaaataaagacaaaaggtttaattcaataaagctatgatgcctttaccattcaaaacgacataaaaattgcacagtgaaacaatagtcatgacagcaaattagatatgacatctaaattacactacaaagagaaatcccagaaccgtttttggtctgtaggagcctattttagcccaggtttagaacccaatctagaggctctgctttattgtctaagtagggtaatgttgtagaagactaattggacgttggttgaattaattgcacatcaattaggaggaaagggcttgtaatactcatggcagagaagtgagtagatcctttaagtatcatgatggaatgtactatgagtttcaggaattaatattatcagtatttgggtaatatctgtataatctattacaacatgacctaaatcaagcacttggggttagatacaggtatactaatttcctccccaaaattagtgcttctcactagaaatgtattgaaacagccacttaaaatgtatgagttatttcttttaaaaatgtagccttaaacattaaaaggttcagctcaggagatcagatattcgtttttttcttaaaactttctaacgaaacactcattgtggtattaccagttattgaatttgtgacttttttatactagctgaaatttccaataagtgtgaatttttttaaaaagtcagtgaacggtgtgaaaatgccagtcccatttgcttcaggcaaattataggatttatatttatccagaattgtttcatggtctcagagatgtttgggatttaaacagatttagtctgactctgctatttttctctagtagttaggggttattttaaaattgcatatttttttcctcttgggaatcttttctcatttacttagcccagaatttaatgtcttaatcatttcttatttgccttaactctattgtgataacatttcttctcatggtttcagaagtgtttatgctccctctatgagacagcactgcctctcacgtttcctcttaatcttttgtttttgttttggtggttggtattttttatttttatttttttttactagtgcttgtaccatgccagaatagcccttaatggttaaaagcaaagtgttcacttaatcctcatcttttcaattataatacaaatttcattttgaagctgacatttaaactgacattgttgtgttttgttttgctttgctttcttgctttgcatgtgaattggcatatgtcattatcctataattcttgataaatttttcataattatctaagggaatcaaccgtaacttttgaagtctaattatgtccttgtgatgtctccagtaaccctgtaggcccaggccaagaactgatgttgattttcacattattaatcagtgccatttattattttatgctgtactatctggttcatataatgctacccttcatatacaaagaaaacccatcatcaatttgactcattcttaaactagttcttcctgtagttgtcatgaatttatttagatccatctgcattctcttaccttgtggctaacaggacagtaactagacagacttagtagcccatcattgagttaaatcaacactgattacattctccctgtataaaggccctgggaaacccttctctccttggcctgtgagccctgcaagccctagcaccatcccctagagcttaaggcttaaactagttcgtagaaagatagatttgctggctaattttagacactgatgtgcttttcttgttctaagaaattattgtaatttcaaatagggtcaaaaaagcaggtctgtgtgtaagtctgttactctctgtcccctcttcgtgccctgaacccttgcccagtttattcagcaaatatgtattgggtctctgtcctatatgatattgcttctagaagtaccaatacttctgaccaattgcttattcatgcattcacctctaaatacctcctttttataggactctacttttgtggagaacattcacagccattatcttttacattttccagacaattccattgtatacggatatgtagttgacacttctgagatgagaaacaaccccaaaaggatgaaatgactctcccaaagtagcaaagcttagaagtgttaagagcccggcttttctttctgccatatctcagctgccctgttcttaatctattagggaaacttcagcctgaagacaagtaactcaaatacaagggaatggtatgaattgctgagggatctcagcatatacctcagggaaggtttcctggtggagatttcctgagttgggccttaaagagtatgtgagattttaataggcacagatgcagacatgtagtttgagacgaagttttgcctttctcacttttctttaagtgccctatttatcttgcttttataaagggagaacttcctttgacaaatgcatcatgatttgaaagcatatctgaattgaaaatttcgtctaaaagtgcttattaagaagcaaagctttaaactcaggactataagcttgaagggcattattttttgagatagggtctcgctctgtcacctaggctggagttcagtggcacgatctctgctcactgcagcctcgacctcctgggctcaagtgatcctcccatcccagtcccccgcccctagtagctgagactgcaggtgcgtgccaccacgcccagctaatttttgtatttttttgtagagatggggtttcaccatgttgcccaggctggcctcaaactcctggactccagcaatccacccgccttagcctcccaaagtgctgggattacaggcgtgagccactgggcccgctgtccttgaagagtattctctcttcactctccactctccactctccactgtaaccagtggtggtgctttgaaagaaattgatccatcctacaggatacatctgtcaaaagtgtatcaaaatgtttttctatcttaaataatttaactcagaatataataatgtaagtattttgacatgaaaatttacatactgtgatatatccacttatcttaaaacagacgtctttaactataaagaaaaggagtgtggtaagacaaaacaaaatagaaattggaattaaatgggatgactgacagaccaaactagttttatttagacaataaaaattaaagtcctgttagcattatgacgaaaaaaatgtaaaaatgttttacttaaagcatggctgattttttgttgtgttttgttttttcactaacaccatggtgaaagtttaaacatgtaagacctgtttatgaagtaaatgtttactgctgaactaattcttcaagtttactggtatattatatattgccttaccaaaaaaagtcgatgctgaaaagtcagtaaaatccacagtaaaagaaagcgtctgaacagtagtctgtcttgggaaattattcaacagagtgcactctggtctctgttagtgaaggctttatcacttttaacaaataagccgcagtaaatttatcagtatgctacaaagaaattttcaaaataattaagactaaactacacttgtcaaaataaatgaatgaaatacaattttgaatcatctttcttcacttattgctcatttgcataattcagtaacttacacaggagtctttcagtcattggtgtgaattagcaaggttctgctattccttgttgtacggcaggaattaccctaccatgtaattagctattccagacatggactaacgggaaataccaaagggcacagcaaaatctaaagaggcaaggcagggaatctaaagacaagagacaatcaaagacacccaacaaactcaagctggtagaccacagggaattttgaatgaagcctcttaatttattttgagaataagaaatcagtagtatgagagaaatctcaacaagattagctgactaagcctacttaaaaaaaatatctctatagtgcatggtgcgccaggttaaccactcctgtttgttagtctgtatacagctcaacaaataagcggcaaagcttttcatgggtatatagtggctttccattgaggttttcactctttgaaggaggtcatttataccaatgagatctgtagatgcaaattgctttccctatatgtgaggggtcattcctttcacagccagcttgctcatctcttttataaaggttttgttatttttgtactgctcccaaaggaatgatgagaattatgcccccccaccccctgtctaacttagcatccaaatcttttccctccagctctgtgaaacttttgtgtgttgatctttggaaacaaaacaagctgttggcagcagcctttaactctgaatcaggaaacttttttccttctttcaacctgaaatatcatctctttagatttgcctttctcgcctaattctaaggaaatatctttttcattgcagcagagtgtcactgtaacatgctacaggcatgtgggaattcctggaagcagtgtcctcaaaatgccatttttagtttggctcaaatgatgtaagctctcacgaactagaggaatagaaatgaagggatcgatttaagggttagctatgaaaacctagcttctgatctcattactgaagtaaagggaaagataatatttgtctttgcctaggctctaaggaatcatacaaacattcaacggttctagtttgttgtgttcaggagttttaggaaggaggagcttcaggcataccatgtgaatgctctgtaaaatgtttgttgttttgttccttccttctgctagcatttgttgaacaccaagggcattggcctgggtttctcaaaagcaatatagggtagtgattaaaaactcagtctctggagtgagagtgccaggtgcaaattttgactttccaccccttactagataagtaaccttgaagtacatctataaaacaggaaaaaaatagcacctacctcaaagggttctaaattcagcaggatgacatggaaataggctaatatgtaaaacgtctgggacattaaacaggcaatacgtaaaatgcttaggacagtgcctggcacatagtaagcatgcagtaaatgtcagttggttttattacttctgagaatactttgtctaaacgactatctattatagtacttagtgttacaactgtatttgagttggtttctgcagcctgtcattgaccatgttttgttcagatttgtatcctcagcatctagcacaacaccaaacatgtagcaaatgctcgattcatttttaccaaatggttacagtatgaaaaaagcatggtccctgttctcaaggagcttaaaatatatcttgataactgtgttttagttttcttatctattgaaatagcatcatgtcagaagtgtattaaaaagaaaactttagttctcagtcttccatacttaatggaagaagttgaaacacgaataatctgcaagccagatttctgattgagtaggtctggggtgggacccaggcggcagtgtatttaaaaatctccgcaggtgattctgatgcacacccacagtgttgggaatctctgagttagtgaaactcttcaaactttaatattgcttcttgtcaaatatgcattaagtttgactttgatatagaaagggagactgggtggcatctagataacaatttaaacagacagtagaaaggaaaatgaagtcaaacacaagaattatttcctagataaaggaagcatttatggtgctgtatacgctaatgtagcatcaaagataaagtgaagaaaaataggctagggaaaagtaagcaagaaggaactgttttctggtaatgagcaaactgaagatgaaataaatgcatttcaacaaaattggctataaagcacattattttcccccattaacttgcgtcatgaatgaaggaatagggctgctggggaggatgggggatctttcaaggagactggataggtaactggggagatattaaggtggaggctaacccaaacgtggtacttaggagcttctgtggtttggatttctgagaccattcccacctcctgtcctcttctacttaccttgacactcagctgactggatcctgggtagagcagccttccgcaactttataattttgcacgtcctccaagcggtctggaacaggatggtagtagtagagggtttaggaggatattcctgtgtcctgtgctcatctcttggggtgctcatctcttggggtgctcatcttacctggggtgtccaggcaggagaaatagcttgactggctatagctggagttataaaatagtctcagatcacccctttttgcctagaaggattaggactgcaccttgttggtacccacaaattagacccttcttcaccagtccctgagcaggccttgactccactatggccacatcctttggctggtgtggtttccctgcctgggttagccaacctcaacccagtctctgttcatattctattcatactttaaggcctcccagccataagtgatctctttgtcctctaaactcctgtagttcttaagcactgtccctcttacattataattatttgaggacagggatcatgcttgatacattattttatgtctgatggcaacttgctcatgataggagcctaataaatggtatgttaaattaatgttttctgtaatagagcactttctgactccatcctcttttctctgctatttatttcctattatgtccttcaactgtgtcataaaaaattttctatccatgtatgtatacattcatcaaacatttagcccataccatctcctcattccacatggacttaatttcccaccttaatctgtctactttctgacaattactaatagagttgggctgtgatatcatgtatctccagaagattacataaattccagcctagaaatttctttgtttaaacctttaggttatataaatcaaactgatgctcagtcatattagtgggattaagtttgaaagtctaaaatcatacttcaaatgaggactgtctcaacccaggcacactccttgccctccagaatttatatacatttgatagcagctggttgttttccctgcagattctttttttttttttttttttttttttttttttttttttttgagacagagtctcactctgttgcccaggctagagtgcattggcgcaatcacggctcactgcagccttgactccccaggttcaggtgaccctcccacttaagcctcccaagtagctgtgactacaggcatgtgccaccatgcctggctaattttttgtattttttttttagagacaaggttttgccatgttgctcaagttggtctgcaactcctgaactgaagagatccgcctgccttggcctcccaaagtgttgggattacaggcaggagccaccgcatccagccacctgcagatttttctagtgattcacagttttagctctctgctccagatgtgttatttggttggctagcctttaatatatcttgaaatgtctggaggccaactccagaaagctctcgtgaaggtgggaaggtgaagaaccgctaagagactttcagactggttttctcttatcacccatgtgactttcagttgagcagcatgcaggcacacgtattaatggcaatgtaggtttgtaaacaatactactaataggctggggctgggggagaaaaatagcccacaagaaatctggagatacctgtcttgagtgtaacctgcaagatatactctaacagagtaatcattgcacgatatcattgtgggagactgagcgagttagaaaatctattcctggtttgtcgctgactcactttgtggcatgggcaaaccattattactctttgatttagttgttttatttgttcgaaaaagggaaaataacatgtgtttaaaaagcactctgaaattcctctgaaaggaggtctataagtgcaaagtactattgttgtttttattattattattagtgttctagtatggtttagttttatgccatgtaggtcacagatgtttcaattcttccgactgatgaattacaaaacacttccatctcattctgttttatagcgttgataacagtttagcacatctttgttttaaccccagttaaagtatatgtccaaaatagacctcattaataaaatacaattactaaattaaatatatctatgctactttctgtttttttttttcctccttaaaaaggtggttaccaacaactactaaataagacctttaattactgccaatcttctcttgaaagtagcagtgcttatcttgagtagtttgaactgtaagtggtattcagtacacagtggggttgtaatgcgattatgaagtgtagcaagttagtgataaataagcgtgataaaccatatatttgtattagaaataatatttgaattatcaactgaataaaaaggctgcaactgctgattcctttgggtgggcatgtgataaaaataaaatacagttaagtatacttggaataaaaaattgtgtatgcttcaatataatagaaaccttttaaattgaatgtgtttttgagtttatagcatttaaattactgggagaattaaaagatttgctttgctttctgacattaagcttttcaaattagaattttaaaaaacatttctaactcattcatcagtagaagactttggcttttatataagatactatagttctcccccatattttcagtgattttccaatggagtagcaataaaaaaactttaattacagtaaaacttgcatataaaatcatgcaagaaggaataatatcattttcttgcctttttttccttttcaatattttagtaatcatagaaataatttcttaatactggagaatggtaatttatataaaataagtaatactgtgactcttatttatatttcacatgaaatgagcagtaaattgtgtgcatttatttgtaagtgtcctaagacatgggaccacatgggaagaagtatagctgccatagcgtcttagaaaccagaggtcgcatagtagcagccacaaactgcgcatgacctttaaatgtgtttaatttgcctgaagaacacctcaaatttctaaatggttgctaatattttttagtgtggggagttcctataaagagccaaatttctggcatttttaaataaaatcaatatgtggctacagtaggtcaacattcctgaatggccacaattgactgaagctgagtagcagctaagcagtttggacagaatatgggttctccagtttgccatagcctcactgcagcccacttcactcatttctgttattcatgtggttactataagcatttgtttgctaaaaaatatcttgaggcatgttttttttttcctctttttttaaccagccccctcccttcccaataaaaaaagaaaaagaagccatgaaacttgggggtttaaacagtaaaaaaaaaaaaaaaaaatccagcagacataagtgtgtttattaaagtaaatcatataaaaatataacttactagctaacctgtttatggcactgtatatttttcttttctttttctttttttctctttttttttcttttttttttttaagacagagtctcgctcttttgcctaagctggagtgcaatggtgcgatctcggctcactgcaacctccacctcccgggttcaagcgattctcctgcctcagcctccctagtagctgggattacaggtacacgccaccacacccagctaattttgtatttttagttgagacgggggatcaccatgttggccaggctggtctccaactcctgaccttgtgatccgcccacctcggcctcccaaagtgctgggattacaggtgtgagccaccacgcccagctactgtatacttttcaaagcactttcacgtgtcctttgtcctcttatcctcacagcatctctgggagtaggataacaattacatattcattttaccaatgagaaaagcaagttttggtggacaccattaatttatccagatttgcaactgctacgtgttggagctgagctataactcatcttcagattgttcatctagagtaacactgtccaccggaactctttgcaatggtagaagtgttctgtatctgtgctgtccagtgctgtagcctctagccccacatgtagctgttgaacacttgaatgtagctagtgcgactgaggaactgaattttccattttacttagttttaattaatttaaatggaaatagtgacatgtgactagtggctaccttattgggcaacacaggactccagagttcttttcctccttcattgcatggtatctttatttaacagtcttattcttttcaataaagttcatcaaaagatttctgttaggttttctgtagttacccaagtggcaaacatctgttccaccagtagttcaacatattaaaatattgaatattttctgtatctgcttagattgccttccataaagattttgaatcatacacaggtagcattctttgtaacaaagtcaggggacccagtattaaagttcttaatgtatattatctcccaagattcctagttcagataaagggcataattagaggtgtgtttaagcatcagaaacatgtagatgactaagaccatctccttccctggtgttttttattttctaagatactagcagctgttacagagtcatgtaggaaacttaacattctctgataattgattggctggtgtaagttggaacagagtgacttttagaaagatgaccattagctaaactctatcagcgtttatcattaaatccaaaatgacattaacttaagacatgttccaatttcagagatgttataacataggagaggagatttatcttaaaattggtgaaatatggtttgtcagtgggcttcatctacatttggtcagcttataaccagggacagcattgagatgtaaatgtcaacttctgttttgccctgtgattaattaaacccttcatcttcaccaaaacaggtccccaccccacccccgcccccattgctctctgcactttggctgtccccttcctcactaccttatcctgattacaattaattaacagaaatcctggtgattaggagtaggcttaagctcttgctcagtaacagtttgatcactatacagatactcactttctttaaacacctccctacccccccccccccccaccaaatgcagacgaggatattttattataaataatactggaacaagcttaaccatcaccttctagcacacaggcaactctgcagcactcttttttagaataccacatgctgtaattcaaattatcacattagctatccaaacacaccatttgtttttaaatactggtgtgtttacctgaatatttccccttttcatcttcccgccccacttcaccagtacattgtcactgcagtgacaggtttatttatgtgccttaatatccccatttcttgttattttaaaaatgtatttctgtgtccctataagggtcttcttgaacatcttaaaatattagttattatgtaaattcatgtcttttcttttccattatgccctttgaatcttgcctttattcagacttcaaaatatttaagcacttctaaactcctgtattacatttttaataccaatctttctctggaaactgagaatgccttctgaaaccttaacagccatcaaaagaaatgtggggatttgaatctattaaaatagaagagtttcttgtccacaatggagtctgacaccctaacagttaccattttggacactgctgtgtaaaggttccaaatacaagccattcagagtttccactcgcatgcaaaactcatgcacgagttagggggtatcatttattaggtggtaacgaggagtcctgagtgctttggtaaatgtgttggtttgtaccatataaaattgctgacattagaccatttttttgtgtacaaaatgtggcaacttcacatggggtccaccctgatactataggtgcagaccagtccagctcatataaattgccttctctatttttgctgttttcccttatttttcctcaattagtaattttactcccataaccttctctttgctgccatccttttgtatttctcagttaatagtattttctctagtgcccttcccttcttaactaattccccaaatctgttagctgcagaattagtagcacaaagaaggctggttgcatagtatgtacctccatgatgcaatcagtacttaccacttcaagtgtttgacctgttttgaggttttcattatcctgaaagggtagtgtctcgaatacatttactgcccaataaataagccagcatagttccttactgctcaaatgaaaaaagcagaagggaaaaaaaaagctacttttttgttcagtgctgatagaagccttgctatgtgatgtctttgttatgacatggctcagctaaagcatctctggagaataaaattaataagtaccctttgttatatttgcctttgtttaactgaatataaattaataaatgcagttttttagtagtttgttgtctttggatctttgtctcaagaaagaaatgagatatgttgtattttataattagaagtgatagagacatcagccatcacttaaaagttggaaaaaaaattctagaaatcataccatttttatttctgtccatttgtatttgtaatctcctagtttccagggtgatgtggtgatacagtgagtgctgattcattcatatttttgttatttggttgccatttttaaagagaatgtcagtagttggtagtgataggtaaataagaataaaataaacatcaaatcctttactgatgaactgttctttacatgtagtcatgctaatcttcacaataatctgctgaatggatgctcttatccccattttacagatataaaacaggtaaacttattttctaggacagtaaattctatctagtgcagacacgcatttgaaacttagggccagcagactccaaagatgttagcccctcccgcccttcctcagtgtcagacatcctagctattgaaaaagaaatcgttaaacatctgtgttactttagtgcctctttatggtgtctattattgttctatgttataagtttgtttttagctttttgttgttgttgtttaccatgcatcaggcataaacaaggtatctgttctcatggcacattctacagaagagtaaagagcaagatcatttcagatagtaacaacccctacagagacaataaaatggggtggtttgatagaagtggataggaagttctttctaagaagctggtgtttaagctgagacctgaatgacaagagggaggaaattctggaagcagaacgttctacaccaggggaacaaccagaggaaaaagtctgaagctggagcatcttaggacagttaggaggcaggtgtggctggaggacaggcaacgaagggaaagtaacagaagatcaagttggacaaataggcaggggctagatcttgaaagaagggctttggtaaggagtgtggtatttccactgtgggagcttttggaaggtccccctccaccaaatgtgcacctgctggaagcactctgtgtattttctctagaaattatgtacggaggtctagaggaaaatgctaaagccttaaaaattacatattaattagggagattctgaagagcatcacaactttcaaaggtgactgggataatgcagtcttattcccatatcagcatgttgtttcttgtgtgctctgctaagcagctgctagagtcctaaagacctctagtatgacagtgagtacatttgtgagttgtgttgccccaaattatagtagggatggggataaagaaatatgtttgtatacaaattcttgctagatactaataaccagtgctggagaaccttccacattagttccaggaagtgcactgtaaagacctgttggttttagttttctcttggtacatttgaaatatgtcactggcttttaaaattaaatatgctttttatgcttttaagtattgtctcttttgaacttttgagtgtgagggttgaatttttagtgagaaaagaattttgtttggatttgtttttaattagtattttttaaaaaatatgttaagggcttctggtggtggtggaaaatattaattcctttaaaaatctggctgtgttgctagatccacatttgcttttctgtgtttttgtgaacaactgatcaaattagattcgtcactcttggcttacggtgatttgaaattgaaatggaatatattaaagcagccaaccacactgattacattgcaagcctcatttaatttcatacattcacactttacagtgaaaggcagcttttttaatgcatgattgtgactgtaccttgagcaactccaaaggtcatctgtaatgggtgcataatttgttagtgttagatatctgatttatggtaggtgtttctcagcctgatttgtactagtagtaaatatggtgagcatcaaagtaaaatctgtaagaagtttagcctgtcacatttggtggtattgtcttattcttcactggtcagtggaccacagtaaatcatggactagctgtcatccttaaatcgagaaagtgccagtactgagcccctgtagcacaggggttaaatgagctattctttttaagagggcaggctggcccaggtgaaggttataacagtattaccagctcatctaacagtacttgttcacagctacttgagccctagtcccaagaaggctataaaaggactttcagtttcataggagcatggacatttgtgagcttgctcttttttccttggttttctgtagcagcgaagtctaccaacttcatttcctttgtgtcttctgtgtgacaggcactgtggggcagccctcagagatccagagcagaatttgctttttgtttgttttttgtttgtttgtttttggtttttttctctttgtttttggtttttttttttttcttctctttttttttgagacagtctcactcgtttgcctaggctggagtgcagtggcgcaagcactgctcactgcagcttcaatctcctgggctctagcagtcttcctgcctcagcctcctgagtagctgggatcacaggtgtgtactgccacccgcccacccccaccagctaattcttttaaattattttttgtagagactgggtcttgccatgtttcccaggctgacctcaaactcctgggctcaagcagtcctctcaccttggcctcctaatgtgttgggattacaggtgtgagccaccacaccagcccagagcaggattaagacacagtttctgccctcaagaagaagacagttggatatggccatttgttccactgtgtggttttaaatgacatgaaatggctttaaccccttcagtgactcaggaacacaatttgcattaggcagtccccattgttcatagctttatcacacatggggtgggttagtacagtgctcacggagaataagactgacatggacttgatgagaactttcagctactttgagaatccagctgcagagttgcctttgattttggttgtgacggtggagacatgtttactttgatcttctgttgcagtctagggtttgttcagagatgtgtagatttgtttttgttggctttcatcaaccagtttgttatattgtagttttcaataacaagagacacctaaaaccattttttaaagctttattattgaaattcctgaatgggaaaaaagtaagacagttattctacctaactcctctcttctctatcggaggaattacttttaataactttaaaatatataggccaagtctggtggctcatgcctttaatcccagcccaccctcccttcagctgacgcagaagagtcatttgaggccaggagttatagaccagtctgggcagcatagtgagaccccacctcttaaaaaaaattagctgagcatggtggcacatgcctatctatagtctttgctacttgggaggctgagaggcaagaggatcacttgagctcaggagttgaagattgtagtgagttatgatcgtgccactgtactgtagcctgggtgacaaagcaagaccctgtctttaaaaaaatcaacaaattatatatacacatgtatttatatatatattatatgtttatatatatttatatatataaaacccaaaattccctaggaaggtaacttcattgttagaaacaaaatagactttatagattagtgtaggggaaaaaccgaaagttgaaggaccatttaaaaagggcagcattcccaatctgttctatgtaattctagtgtcattagtattcccggggtaacaaagactccctgaccaaagaagtttagaaaatgctacattctatatcccccgcccctttgttgttttcaatgtatattagcatatttaaggctcagaggtgtcctacaatagaaatttgtttaattttgttttaagccagctctctccatatttatgtagatgcagggcatagtttagaaaacgctagaatagaattttggcaatcattcattctcttttacctttgcttaataaatagttaataaaaattcaagactctactatctcctgaactaacttaaacaatatttttgaatacctgttacatacctacaaaaggccaaaaaaagtatgaaactaagaaaataggcagtaaaagaatggaaggaggagagaagcaagtagcagccatgaactaaaattaatagtactgatgagtttgtggataaagaagagagctgatgatgaaaagaccagattgggatgggggtggacagacaggacctgcatatgagtcatcacctgtgggtattgccagctcccagacctcaggacttgtggacaccagcatgccacacagaaggctgttggctggaatggttcaagattttagtagtgtgttatggccacctagtgcagggttcacaaactcaaatgcctttaggaccatgatgaattatacatgctgttttcatacagaaaacatgagctctgttttgccagatgttctcatttttcaaggagaggaagaaacacagatggtcctgtggaattgtctgatgtttgaacactggctgtagtttttgtattgctttgttaaccaaaactggggaatactgggtgaggacatggaaactctcttgcatttgctgatgggagtaagttggtagaagaaatgtggcagtatctagtaaagttgaagctgtgcaaacataagacccagcaattccatttctaggtgtatgccctagagacagacaccacccccaacccccatgtaccacgctcaaggtgatgtttatggatgaatatccgcactgtctataatagtctcctaggtaagtaagtgacagatagagaagtacatataaaatgatttatataaattttaaaaacaacattaaaatagtatctatgtgttgtttgtgcttatacaaatatatagtaaaagtataatatgcaggtagaaaagagatacagcaaattcagaattgttgcctgtaggaaatgggggtagacaagctatgtacactaggaagccattgaagattttaagcagagaaggggcatggcaggatctgatctgttcttgaaggtcactctggctgctgcatcataggggaacaagaggagacgcgaggaaagtagttggaagattttagtcatggtagtcctgcgtcttggtgggagagaggtggcttgaattccaaatatagtggagattttctcaaccttggcactgttgacattttgagctaggtgattctttgttgtggaggctctcctgtctcaccccacgactgagaacctctagcctcagctgtatattgggaggttaagagtaaaaatttctaatccatttttaagaggaagagatcagatggagcttgagttagtgggaaaagaatgagtggaggaggcgagacttgaggtgatctttgcgagaatggaacagacacagtcattccagagacactaagcattgactattttaaaacttaacaaaagcttttctttaatcttatatttccctgctcccacttctcctttgtaagattcttgtaagagagctgtatataggctcttcacttctctagcatttagttcactcaacagctctattgctcacagcagggtccttagtgacttcctagttacgaaacccaatggaatctttccaatccatctaccattgacctctccaccccatttgttttccatttttaaaatgatttcctcttacataatcaaaagtgcagatcacaatgtatgttgagatgttaatctatatgttcatatagtttgaaaaattgtacgtcctttgtatcatagaatattggacagccattacaatgtgtattattatccatgttctgtaaaagtgaattgtatgtattaagaaaagcaggtttcagttccgtgtagttaatatactctcccctgtagtaacacacacacacatatattcatgaacatcagtttagaaaaagactggcaggaaatgcactgagatgccagcagtcattttcctgacagtgtgttacttttataattgaggcagggggcagcgtactgaaaacattggtttatcgagtttcccctctgttgtcttctgtctgtgtgcattctccatggatgatctcatctgtaccctacacaccaaggactccaagtctaactcgactgatcgagtcctctttcagactgacttttggactcgcatacctattgatctcctagatagatccactgagatgtctgtcccatgaacatctgtcaaaatcaacatgtccagaagtgaagtcattgtattccttgttccccactagctgtttcttttaccctccctttcccagtcacaggcactccatacctatcctgtcatccaagccagaaacaatcctatagactcttctctcccattccctccacatccagtccatgtccaagatttgtggccaggcacggtggctcacacctgtaatcccagcaatttgggaggccacagtgggcggatcacgaggtcaggagttcaagaccagcctggctaacatggtgaaaccccgtctctgctaaaaatacaaaaattggctgggcatggtggtacacgcctgtaatcgcagctactcaggaggctgaggcatgagaatcacttgaacccaggatgtggaggttgcagtgagccaagagcgcaccactgcaccccagcctgggtgacagagcaagactccatctcaaaaaaaaaaaaaaaggatctgtaagctggttctacctctaagtacatcctgcggctctctccttctaccattttcacttgctgccaccgtagttcaggtggtcctctcaacaggattcctagacaagtcttactggtttttctacttctagacctgctctgtctgttgcagtagccactagccacgtgtgcctattgaacacttgaaacgtgcctagtttaaattgagatgcgtcataagtatcagatatacctcattaatattcatacactgattacatgctgaaaggataatattttagatgtactggattaaatgaaacattaagatttacctgttttattttaggggttttaaaaatgtggctactagaacattgaatgttctcagaatggcatatatggcttacattatattattatatttctactgggccgcactgtgtctaagcagtcatcccccctttgatttatcctccacgctgctgtcagaattatcttgctgaaaaacaaagtccctgagctaaaaattctttgaagtcttttgggataaagtttaagattagcttaacacaccatgccttccctaaaggcattcagtttcaaaaacttttgaaacactgtgctgtccacagtgtccggttagattcagctggtaggttgccagcttccaactcctgatctaaggactgtctgtcatctctgtggcacctctaccctcaaatatttcaatagttgttagacaattgatgcactataaatagattgaagtagagttgagcatatgagaaagtaccctgtatcaattctacattcatgctaaataaaaagttttatacagacccttaagggacagctacattcctaatactctgttgaaagttatccactgagctgcgcacctcttcctagtaggccatatgtgttagtgggcactctgaggagattgaagtggcttcgaggacccagcccccactaagagctgacggcgagtgaaccaactgggaaaagaaaccttcatgtgttgacagtatcagaaagattcgatggaaagctactaaatttgaaaaatcgatccttataagataatctttcttttggagtggggggattacaaacaggaggatgttagataaaatggcaaaatgtttaaaaagctcaactcataggaggatgttggatacaatgaccctccagaaaaggagttctgaaatactaaataaacttaaaacagctgtatcgtaacaatattttgactctccaaaatatgttttatttgtccataagtatgtgtctaggatggctgacaaacttagagaaccatatctgaggtatttatcagtgaggacattcactaggttgtatcctaaccagcacaatttgatacgtatgtaatgccagaatagccatgaacaaggcagaactaaagttattttcagatactgaaatactgtttttactttggctctgctgttgaaccacagagttagaggcttaattttctttctatcaatatattgcttttattttttctgcacaggaccttaatgttctgcatgtttagtgaggacacttctacttccagtgtaatagcatcatgcttttagagatgcacttgttagacatttgcagctagctgttcctttcatgaccttgtgactggggcttccataaagatgcactcctgcacaactcctttcttgcctcccactacaaaactgtaaactcggggatactagtctggtttgctcagtcagtttctgctctttttcaccatcttgcttggatggcgtccctttggtgtctagcgctctcctgctaccttgcctccttctcaatctctaaaataaagggaaaccttctgtttgtaccattcaaaaactgaaaatatttcttttttgatgtgtttatattattatttccagggttatttgtattgtcagatttaacttgctctgttttatgtggaaatagtgccaaatattagcaagtagatgatgggttatatttggagcagggtactttcccgttgttcttaaaatcacatatacacaaagttgtccctaaggtcaaccctaaaagcacacctgatttatttcctcttcgagtgcccaggagaaaagacctcctttctacttcctcttctcccaaagtaagcaagactcactaagattctttggctgtctctggaaccaagaatgggtttcacctgagctcagccattcctccaacagagagattctccacttcaaatgcccaataaagcctaacttaggagcttttttaaaaaaatctgcccagaccagttaaagctcactctctgagatggacccaggcatcagtataatttcatcccagcatacagcagcagttgaataccactgctctaaaaagtcttaaccaccttcatgcctgaagcttgttcctagcctgaaagtttttgagaatatggccattaagttccacaggggaaagagcattgtgatgttagtcatgacaaactataatgctaccacctgctgacagctgccatttattgatcagttctgtgtcaggcattctgctatttctctatgtaatctttatgtttttactgcatctttatatatatattatatttactttttatgctttactatgtttaatcttaactgtgaaatgggtcttattaccatttcacaaagaggaaaaggaaatgttaaagaggataggtgatgtgatcaaaatcacacaactggtaaacgaggagaaacagttggtaatattgatcacatgttagatcaagaacaaagaagtgaaaaactgtaaaaaaaagtagtttgactgtatactaattacagtaaattataccaacagtttaccatttgtgcctaattacaatatagcacaataatgattatgattataaataccattaaacagatatcgcattaacttgggcaaatttcttttgattacagaacagcttaaatctttattataaataggtgtggaatgaatagctgataatcataactaatattttattgagtgtttactatatgttttaggcatcacagtaaggataaggactttgcgtacattttgtttaacctttaaaaactaaaactctgaggttggtactataattattattagaagagaggaaactaaggcttggagaggttgaatagcttacttggtaaatggcatatccagaccttccactcaggattgcgggactccaatgctcttcactattccatctccttatataatatgctgcagattcataggactgttcgtgtttgctcagcctttgcacttgttactaatgtgggctggttatctattcaaaactttcaacatgacttgtgagatggatataattattttaaaagtctgcaagagtttccttctaagctattaatagttttaattttgaatatatataatgggtaaccccatgaaatctcactactatataagaatggtcccaatttagttattctcctctcccttcaatgacataaaatcaacatatcctcttagattaaataatagtaataacaactttcagggtcatcttagttctttgaactgtgggttttattaaggaatagtagaatctgtgcatatttaaaataatcattttgtactgaaaactgaccccaaaacatacacatagaaaggcctgattaataacaaacattattatgaagtgttttaggtgggaggcattcagttctaaagattatatacaaaataaacctgaacctagatgaccttcagtaaaatatcagcatattaatatgccaagaaactcaatggcatgtctgattccaattcatcgtgatgaagaaagagccatcttgccccaactcttgctcagagcagtcgcacaggattgtaagtgatcgtcttaaaagactctttgtctcacctttgtcaaaatcctctttcaggggttacagccggtagagaacccataggtttgggggtcagaaaacctgggttcctgttgtagagtttctatgaagtctccagaagattactgtgctgtgagttttccagtcttaaaatagggacaaaaactcatttttcagcatttctcaaagagatattgcagaatcagtaataacttggtaatgttttagtaatgcctgtcctttaaagagtaagtatgtagactaaataagatacatgtacatagttgaaatccagtaaatgccactcatttgatatattatggtaagtctacaataatacagaactcttatttgtaatcatataaggcatctatagaatgttttaaaaaattccttaaaaacaaaaggcaacatatactatgtcagcaaaatcccatttttaaccacttagaaataagttatacctaatttttcccccaaactaataactccctgccagtctgttttggcagcgtagaagttgttttcaaatcactaaaaccctcatgacctaaaagttgtgaaatttgaaggagtttgtgctgccgttactcttaagtttttccctaggtgctaattgagtcaagtttgttctgcattatgatctaatgcaggcacaatcaaggatcagatgtcagggtgtcagatagcaggaagtgctgattggtgggaagctggggaatgcaagctctacccaaaggcattaaaattcttgaaaaatagttgaacaccattagctatacagacacaccttctagctagattctactgaagatccaccaattcacagactttcagctaataaatgtcttatgataattaattctacccccagaagggaaatagtcatatgccacttcatgctttttaataagttgattgtatgtaaagatttgagtttaccaggaagtttacaaagtaaattatagttattagagttcaaataaaaatgtttttatgacaaacaactaaagagtgaattctctacatgaattctgatgttcttatatacatcctagaaatcttgaattgtataaaatgttatcctgacatttatgtcttaatttagcttactgccttgcgcagagcacacaagaagtattgaaattaggtagctgacaccaaataaatacttaaggctctttataatacgttattagggaatctgtaatttcaagttatggaccatattaataaatactgcgtattttgaaaggcacttgacaccagtcacattcacctagagtaattctgagtagttcctcacagattccatggggaaaaacatatggttcaagtctcataattccataggcaattaatatatcaataaaagagcataacatttgtagctgtcctcagccaagtacctactatgtgccggacacagtacaggccctttttatgcattttgtctcaatttactcctgatgctaattctgggaggcattattgctatttcaccaattgcagatagagagtctcagtgagattcccatgaagatggtaagaaacctttctgctgctaaatcctgtgctggtaagctatctataccatatatctatagtttaaaaaatcaataaggacatcggtgaatggactgcagcaattaaacgaacctagttaaccttgtaaatccccctatatcagatcactatagggaaggaagggctcgataccttaaaattcccagtagagggtgtatgcccccattgaccaatctgactggatgtcaaactttggtatccgttgtacactgtgtgcagaatcagtatgtgctagaattatgtataacaaactaaaagcctaccagatgttggaaaacagtaacatgctgataccaaggtgggcttggtaagtgaaggatcagcatgttttcttttctaagttaaacttctgaattttcttcaaactcttctgtctctactcatggtccctcagcccaaatctggcttcttctgtggtctccagatagagttaaacacttcctcacatagctccttgtatgttttctcacatatgtttcttcttatgcatctctcttccactgtatgtgagttccttggagccagggctaattgctttttcatccttgtgttgctaagcactaaatccaacagtgtgtctgatggtggctgacaaatgaatgaatggataaaaccagtaaaactgcctgacctcagcaccattactccctcccatcttttagttcttggctagttagaaggccaggttctgtggctgagctcgtaaaagttcagctgtattgtagaaatacacagatatataaatattgtagaaatatacaaagcctttgctttcatggttttgaggaaaggaaaaggtgagcagttagccaaactcttagattaaaaagagcaagaagagtgattccaggaaagttttctttttcacttgtatgtttttgcagcttttttcatagttttcaaagttgtggaaccctctcctggtgttaagaacctgcttcggttcttaaaataaacaaaggtatcaaaaagtcctcttgctccaatattttcacctctgattggcaattcaaatgtggaaagcttctgaaactatctttaagtagcttcgtaagatgacaaaagccctatatttagtaatgtctaactgaagtttgttttaatgatttagaaaatatcctagtattcattattataaagtgtttattttgcagagttttcatttgaaaaactagcaactctgccttaccatagaaatgcatcgttcttcaagtttttgaaaacattttggttctacatattagactttaactcttgaatgctagccctgcctagtaataaaacatgttttttttccagtgccacttaatggcaagtctcttcaagtttctcaacagtcaactgctgtaaatgtacctgaggtacattctcattttctagagggggaacaggaaaaattccactgccaccatccacccctgtcatccaaaagcaagtttattagtgaacttcaagtcagcattctaaccctactatctggtctctcttttttacttttttatccttttgggtttatcaagtccttattttaagattaacatgaagaatacttaatgttgtaaaggctacatggatggttttgacatcagagtgacaaaatatgttttaaaaggataacaatatctgagtgcatgtttgtaagagcagctagataacatggcaaactctgacagcaatcatttcttcactcctgccccatttttcctaagcaaatacacttagggtgctcttcagtggtagtgtatataaaggatggtctccaaaaagagattggcagctttaatttgtttgatatgtgcaatcatggtccgtgttaaattcaaaatgcttgtccaatcaaggattcaatatagaaaagaggcagtaacaagcatgctgcacactgtaataaagaaatctgttgattgaaaacagtttgtatattttggaaatgatagggaatgtaattggtaagaaagaaaaggatagggcttcataaataatgggaaatagagcatattttttactgataatactaactcaatttaataacattttggtgttgaatttttgtgtgccagaaaataagaaagatgggttcttttttgttactctaaatgtcatgattcatgggttgaccttttttgtttttgtgtccatcgagagcagctttgacaggttgaatcaggcaatagtgggtgatacgttccggttctttgagaactttcacagaacatttttcttttgttctctcatccaagaagacgaaacatatttttaactgttttttttttttttaggtacaagtactacatgaatgcatttctgtggtaaaagatctaaacaatagagaaatatacagagcaaagtctgtatacttttcgtacatagatgtctgggtagagatttgtatgctgattgtttgaggggctgtagtattaagaaattgaggctgggcgcagtggctcacgcttgtaatcccagcactttgggaggctgaggtgggcagatggcttgagctcaggagttcgagaccagcctgggtaacatggcgaaacccattttatacaaaatttagccagttgcagtcgtgcatgcctgtagtcccagctacttgtgggactgcaacaggaggatcgcttgaacctgggaggttgaggccatagtgaaccgagactgcaccactgcactccagcctgggggacaaagtgagaccctgtctcagaaaagaaaaagaaaaaaagaaattggattttactattcatgtcattctcaagcttacttaagacctcacagatagaaaaacatatataaagtcactctggagggctgctattagtggctctccactagaaacatgttgatgcggacaccactagctgtgcctggggtgagttagctgggacccttttcaccaagcaccaccccaggtcacaagtgtccctttggagctgctcagctcagttggccagtatccagctttgtcctctctgaagaaaaacatcaacaatttaaactgcgagcactaaatacacttaatggtacctttacctgtcctttttttcctgttatttagttcctttccccattaatttaaaattctgcatctagacttagcactagtaatctcatcttgtacaaaaatctaactattcagaaagtaccaactagaaattttcagtgtaccatggtggcaggtgttcatgatgatggaatactctctaactcataaaagagattgtgtacaatatagttttgttattaatttatgctactttattaacattttaaaaagtggtcaacagtcctttattaccttcccattaaccatcatgttgaggtaactataatacccagttccctgcatctgttctaaacaaactggattttactagataaaaaatgaaattactaataaaaggttaagtgatacatttagcatacatcatcagattaagcatttgctataagaagaatccaggccgggcgcagtggctcactcctgtaatcccagcactttgggaggccaaggcgggcggatcacaaggtcaggagattgagaccatcctggctaacacggtgaaaccctgtctctactaaaaatacaaaaaattagctgggcgtgcgtggtggcgggtgcctgtagtcccagctactcgggaggctgaggcaggagactggtgtgaacccgggaggcggagcttgcagtgagcggagattgggccactgtactccagcctgggcgacagagcgagactccatctcaaaaaaaaaaaaaaaaaaaagaatccattgtattggtaagctgtttttgtgtgagattgcatttcttcctctccaagcgtctagcacagcactttggattccaagttcaccaaactttccccctctattcaattgcattaaacatgtattaaacatcttctctatgtcatgctttctaagatgcaaaaaagttagtatccttcttctctaagaatccataatctagcaggatgcggtggctcgcgcatgtaatcccagcactttgggaggctaaggtgggcatatcacgaggtcaggagttctagaccagcctggccaacatagtgaaaccccatctctactaaaaaatacaaaaattagctgggtgtggtggcacacgcctgtagtcccagctacttgggaggctgaggcaggagaattgcttgaacctgggaggcggaggttgcagtgagccaagatcgcgccactgcactccagcctgggtaacagagcaagactccgtctcaaaaaaaaaaaaagaatctgtaatctaatggcagaaagggggcctgcatagaagaggtattcttcattctgttgaggtggcagaaccctttatctcccacttataacagtgtgccagtggtgaaaaaagcaaggtgagaacagtctgaagtcagggataagaaaggaggcatccccatgcaccccaggaaagcacccctaatgatagaatttatccctgcagggaaaaggtaaaccaagataccatgcaattgtatacctggaacagtactcttctgaacttgtttgatttcatactcttaacattaattttttttttttgctgaaatctctgatatttatatatgtaattgtagatatataggtaatttgaaagagcactaatgtactcttcctgtgcaagatatcctgtagaacatacgcaaaatatgcattttttttttccttcaacttctattttaagttcaggggtgtatgtacaggatttgcatatttgttacataggtaaatgtgtgccatagtggtttgctacacagatcatcccatcacctaggtattaagcccagggtccattagctattctccctgatgctctccctcctcccacctcagccccctctgacagcccctccccccacaatgtgtgttgttcttcccaatgtggccatgtgttctcatcattcagctcccacttaaaagtgagaacatgcagcgtttggtttccttttgcttcgttagtttgctgaagatcgtggcttgcaactccatccatgtgcctagaaaggacatgacctcgttccttttttatggctgcatagtattccatggtgtatatgtgccacattttctttattcagtctgtcattgatggatgtttaaattgattccacgtctctgcagacataaagacaaatggaacagaatagagaactcagaaatcagactacacacctacaaccatctgatgtttgacaaacctgacaaaagcaagcaatgggaaaaggattccctatttaataaatggtgctgggagaactggctagccatctgcagaaaattgaaactggaccttccttataccatatacaaaaattaactcaagatagattaaagacttacatgtaaaacccaaaactataaaaaccctagaagaaaacctaggcaataccatcctggacataggaacaggcaaaaatttcataatgaaaacgcaaaagcaattgcaacaaaagcaaatatcgacaaatggaatatatatttaaacttaagagcttctgcacagcaaaagaaactatcatcagagtgaacagacaatctacagaatgggagatagtttttgcaatctatccatctgacaaaggtctaatatccagagtctacaaggaatttaaacacatttacaaggaaaaaaaaaaattaaaaagtgggcaaaggacatgaacagacacttctcaaaataatacatatatgtgccaaaagatacattcttaagtggatatggttgaaaaacagtattttttaaatattggtgtgtttttaatccagggtgttttttttaagtccatttcgagatttttaatttagttaaaactaacttgatcttgttaaagccacttaactatgcaaacagaaacttcactatatcccactggactgaaagtgaacctgcccaagaggggccctctatcaaatccttgcccatggaacagggtcaaaaacacaagaaacgaggataccttctaatttgagcttcacacgcagcatctgacactcaaaccaagcaaggtggggctaatgtccacccaactagcaaatattagtaaatctcaggatctttgttttagattttaaatttttttaaataaaacacagatgtataaattagtccagaaggtttgtgaccctcagtagccatcctgtgatttcaatacatgtcttcttccctggtcacaagaggcaaagggtcaaatgagcaccacttcagaagggtgagcacaggacagtgtcgatgggtctgttcaatcttgaaccctcttcccaaagctgggagtgtatctgtttgctttaaatcctgtgaagccgggatgccccttacacctgacctgctttcagtgcagactgtcatgtacgtggacctcagtgaatgaaacctgggtgtccatatcttacctgctgctcatcaaaactgcaagaaagaaagcctcttttgatgagcagttgtactacccctaccagggtatattcagattggtggttttatcatttccaaggagataagacagtgagtgacatgtagctagtgcaaagcaacaaatcatagcatgggcagggcaggttttaagagttatttgcctcacactgtcccctggcacttctacctggctgttgaagccatcatggcagtgctaccaacctccactcaaccaggcacctgtgactctgttttcacccctggaaatacacacacccatacagataggcatttaagcaacatgaggactggctggctgtttttatatttactaaccatggaagcactatcattataaattaatcaaaattttcatttccataaacatataatagtgtggcttagagagtgtaaagggtgaatttatctccctgggctaagtattacctcactactctaatatgtggaccaagatattattcaggattttaaagatggaggggggatttcatgaaaagggaatggatgtggaagattttattttattttattttattttattttattttattttattttattttattttagaccgagtttcactcttatcacccaggctggagtgcaatggcacgttcttggctcactgcaacctccgcctctcaggttcaagcgattctcctgcctcagcctcccaagtagctgggattgcaggtgcctgccaccacgcccggctaagttttttgtattttcagtagagacagggtttcaccatgctggccaagctggtctagaactcctgacctcaggtgatccaccctccttggcctcccaaagtgctgggattacaggcgtgagccaccgggcctggccggaggatttaatttttaaagttgctagaacctgatagtttgtttaaaataaaatattcagaagaacttaggggaaattatgagtgggtattattatggtggtgaattttctgacatcttctttatcctgctctctcacctctttctaagcacctgatctgtttggaccaccaccatacctagagttttagatgtatcagaaaccaccaacattggatagaatatgctcaccctgcagttcccaaacgtatatgctgcacaagtctagcaacctgaactgagaaaggacctctttcttgttctctgttccaattccaagtcccgggaaaaggctgtcggcatcaccctgtatagaataactgcttaggggcacactgtttggatgaggaaggggaccaagagtctgggagaggttttccatagacctggctgtcacaggtttgcagaataccctgcttatctaacaaggtctggataaatcccttgctacttgagctctgacaagatgagagagtttttcaaataacctttcctgagaagctaaggaatctgtaaaagtcagcaggcttataggataagttccactttttttcatccacaattagcttgcctgttgataattaaccagcatggttgacaaggcacccagttcttgactttttttccttccattagccaattctggcttagatattggagaagggaccctagacaaagaagcttagccttctggctgaggaagatgtgggtaaggtatgttggcagatctggtggagtccgtgatcatgttaagaaacatcttctggctgggtgcagtggctcatgcctataatcacagcactttgggaggccaaggcttgcagattgcctgagttcaggagttcgagaccagccatggccaacatggtgaaaccccgtctctactaaaaatacaaaaaattagctgggtgtggtggcacttgcctgtaatcctagctactacttgggaggctgaggcaggagaatcttgaacttgaacccaggaggcggggtttgcagtgagctgagatagcgccactgcactccagcctgggtgacaagagcaaaactgtctcaaaaaaaaagaaaaggcaagaaagaaaaagaaagagagagagagaaagaaaggaaaagaaaaaagaaagtcctccaatgtttgtgcctaggcctgaacctcctagattgtctccactggcttcaggctgtgtccactctaaaacatctctagccttcagggtcctatcttggcctttgtcatggcatgtctccagagggttctccctcttcccagggttacctgagtatacagcctgcagtaacctgctctttctctaggtgcttccattcacctgaaatgtagttattctccaaaggcaggctctctttggttattctgaactgggctctccataatccctcccctcccaccatggtcgggagtcttcctgggagccactgactttctttggcgaccatctacattgtattggttgctgcggacaaccaaaagcaaacctgtatgtactgttttcctagttgggtacccacccccacacaagcttccctttcttgggggatgtgtctagttctcagcccattttcagaacagaaatgtcgtgaatttagtatttgaccagttttttttttccccctaggcccagattctcttgagtagctcattgttcatacttgttttctttttcccattaaatcacctacccaggagagtattttgttttctaaaaaatagtcacttatcaattaaatgacaggaaaaaaaaaatccaccccagagaggagacctagtatttattggacacatgggaaaaatgagcctttctaacagagggatggtcatcttgtacaagtacactgagggcagctgttctcaaccaggatgattttgcctccccacccgagggaacatttgacaatgtctggagacatttcattgtcacaagttggggagaagcaggagggaggctgctgctggcgtctagtgggtagaggccaaggctgctactaaacttctacagtggacacaagatagacccacaaataatgattggcaccaaatgttagtaggttaagatagcaaagacttggaatcaacccaaatgcccatcaataatagactggataaagaaaatgtgacacatatacaccatggaataccatgcagccataaaaaaagaatgagttcatgtactttgcagggacatggatgaagctggaaaccatcatcctcagcaaactaacacaggaacagaaaaccaaacactgcatgttctcactcataagtgggagttgaacagtgagaacacatggtcacaggaatgggaacatcacacaccggggcatgttggggggtggggggcaaggggagagagagcattaggacaagtatctactgcatgcagggcttaaaacctagatgatgggttgataggtgcagcaaaccaccatggcacatgtgtacctatgtaacaaacctgcacgttctgcacatgtatcccagaacttaaaaaagaaaacaaagaaaccctaatatagggctagtgagatggctgtgtgagcgtgagctggtgaggaagggcttggggccactgtgccagtgctgacggaatcctcgatagtattttgtcaagtcgaaggacagtaataatgataaatgtagcaatggttttctagacacgaggaaaatggccttggtctttgggtggctactttgtttgtttgtttgagatgaagtctcgctctgtcacccaggctggagtgcagtgacatgatctcggctcactgcaacttctgcctcccaggttcaagcaattcttctgcctcagcctcccaagtagctggaactacaggtgtgcgccaccacgcctggctaatttttgtgtttttagtagagatgggttttcaccatattggccaggctggtcttgaactcctgacctcgtgatccatccgccttggcctcccaaagtgctgggattacaggcgtgggccaccgcacccggcccttgggtggctactttcatagaaaggcagctatgctatattgatatggaacagaggcttatttattaaataaattcactttagcaataataaactcattacatgttaacatagaaaccttttatgaaaatagctatatctttcaaaacaaaaaaaaaaaatggtgagaagagcagcattgttttaaattttggcaaatctctttattctctggcttaatagaaagccagcctgatttctcatctgcttctgcattcaatctgtggtaacatcacacatcatgtagcctctggaaactccactgtagacccatgagagaatgagagtggaaaaagccagtaatgtcttcgtatgatttcgaaaaaagttttgaccttgaagacccctaaaagggtcactccagatgtcccctggcccacacattgtaaactgctgctctagaactgtgagatctgtgaagcagaatggggaaaaagtcacatgtttaatttcactactctttaactagaatttagcgcacccttcaaatatggatggaggcctcagaatacagtggtattagcagtatctgactttgttatcagcagtagacgtcaaggatgttttctgatcacattacagttgttgcagatatctaaaatatcacttagcattgctttgaaattttactcaccacagtgctagatcttgtctataatgccttaataagaaagtacatacactactataccacaggtgtgttctttaataccgacaagtatatttcagtgtaattgctttactttgcactcctatgttgttttatttgttttacctatttaaaaacattctgagataggagctgtgggctttagttgactgccaaaggagtcctcggtacaaaaaaccttcagaagccttactctagaaagttacacagccagaaaggcatgccttggccattttgggaaagcagtacagccccaaagcaagctcaaatcggagtgtttgaagaaagcaagttccattgccactgttgtcggcctgtgtcctgcccacctctgtatgcacagccacaacttcaagtaattacaataaagtgttgatcatgaacactcccagttttcaaaaaagagttaaccacccctgtaatgtacattttggataaaaatttcctttaaaagttctcattctcataattcacaataaattccagtcttctcagcaaattcagctaccctaagagttctagagctaaggtgctcctgtcacttgatgaaagttaataaagcttcccaaatattcctggacagacacagaaatggacaatgattgcttctaagaaaggacatgggatgagtgggagacttctttgttggttggttaattttaatttcattagttaaacatgcacataatttgaattatcagaagttcatatgtctggttacaaaaagcagtccctttccttcccatttcccagtcttcaaacacaaccacttgggactccttccactgctgttttcagtattcacctccttatctctaaataataggcacagagtgcatctcccagtaatctcctacaatgagaaaagaggccttaacacctccagccatggtcctcaggcagttagagcatgattccggcagactgattgattgataccaatagccactattgatacataccaattcttcctctgcttttctaaacctgctcttaaatcagttcacacataactggtatctgagctgatgaccctcgcggcctgatgcacagctgttatcctgggaatcttcctttaccatcatctgggtattgccttcacatatcacttatttcagagtccctgtgccctacagtctgtatctttgtttactgtccctcttttggggagaggtaaaacatctcttccagtagcttcctgagaaagagtacttggcagatgaagcttttgagacctttcttgtcttaaaatgtccttaattcaccctcatacttaattgatagttagatacagaattctaggctggaactcagtgttcctcataattttgaaaacattgttctactgtcatcttttttagtgttgcttttgaaaagttgaaagcttttctgagtcctaatcctttatatatttgacctgtgtcctttttttttctccttccttgttagacacttggaggatttcctttgcacccagtgcatgggcacattcatgatggtgtgttttggtctggggcagttttcatttatggtgctgggtacttggtgggctctttccatttggaaagtcaagccctccagttctgggaagttttcttgaatttcttctttgatttccttcctaccatgtccaattatgttttaatttctaagaactagaattttcttgtttttgcagtgttcctgttctcatggatgtgatctgtcaataacttgagatctcttcttgtgtgctggtcagattccccagaatagatccagtctcctccctgaagaggattagctggcttcgggcatctggaacttggggtcttggcacagcatgccttggtgggctcagagaccctcatcaagagaataagccttctgccagagtggaggtgggggtttggggtctctgtcttgaatatactttgaaccggtcttcactcatacttccagagatagcttggggcaccaattcatgagcctttgggagtaagtcatctcttgtttttctgctcgctagcttttgctgccagcacctccactactattttcctctttcttggagtttcttttgtcttttaaaaagtcccttactgtaatttgagtgaggatttgggagtttacagagcaaaatatgtgtatttagtgtgccatctataaccagaaatcagagagttttcaatgtaggcttttttgtgtgcattttgaattttgtccacatttttgtactaggaattcaatatttgtaaatcaagcttccatctttgttcttacaattaagagggaaatgtccacttctgtgtgtactatcctttgaacgttcaaaggcctcacaatatttgtatatttggtacaatgtaccagatgtttgcagggatcttttttacatattacctcatattccacccaggtcaaatttgatgagaaagagttcttttttctttttggttagattctagatgatacccacagttcaaactgtaaaagaataagtttgccaatagtaataattaatagcatttattgaacactaagcaccagacactattataagcatgttctgtgttttaacttatttaattttcacaactaccctatgaagtaggtactgctgttgtccctaaatgatagatgaggaaatggaggtccggagaggtttaaaagcctgctcaaggtaacatagcaagttaatggcagagtcaggattgcaaccccaatagtctggctgtagagtacattttaaacataactactgtgtgcacaaggctaatgatttatggattgcatgaataactaaagatgatgtccccaactttgttagagatatccccaaacttccttaatggatcggttgtcataacttcaccaacttacagctctttttttccacataaaacttgccaaaatgccttcagactgaagggagaaaaaatttaactgtttccttcaaattaaattttattagcagagaactagtattaagatcattgcatgaagaaaatgtaaattagccgcttactgtaaaatagtattagagaaggcaagtgataaacatgtctattcctctttttccctttattagtggttaataatcaataaatagcagcttaatgattaacattataaaagattacataagagttttagaagaatttagattttctttactaggtagtcatcttcatttttataaaactgacatcagtgttaagccatttttaccacaggttaaaatttgactgacctattctgttgctgactgagtcataccaggtcactgaaacctaaaataagtatgttgtaagcatcgcgtaacaattataacctatttagatccaagatccacttaagacatgttgacttcttttctgcatcactgagatggccgacacatccatcaataatgtgctgaagttctcattagctctctatacagggaaggatgccagcaaaatgtacagaagtaaattcactggaatctctggtcagaaattatgactgttctatatgtcagcccatgtgttgctaacagatttttttctttacaaaaatgtgttttgtggtttgatttgacccatggttcatctgaatccaggcaattacacttatattaagggttctactgtccactttctcctcatcttgagaaatgtcaaaaggcacatatcctgcatctgaaggaaacacaagaaacaaaaatggaaatgcctgaagagtgctttcacctgcattaatcaagggacagctgctgccattcccaaggcgctgccctgcagttggctgagcagacccacatgggcctgctgaattaagtctgaattaagagtcagactgcgagtgatgctgcctctgtgtttaggtgaaaaggccactttagcaagtgtaataaaatgtatagactcaggtgagactccaggggaaattttgccccttgagtttgggttggagaaatgacctccagatctctaatatcattcactgtggaggagatgtggaccatgtattttttccttttcttccctttataagatggtaatttccccttagggatttgggtttctctgttgtatgcattaatagggagatgggggagagagagagagagtcacaaattaaagtcattttatggtaagtgtctatgccttttcacctctatgcttcactttgtagaactcgtcaggaaaatcattcaggtgacgactatgcattttgatgttaacagatccgactcttaccgggtagacgaccagttaacaacatgaaataaggcagtgatggtttttgaaatgaaataatgtttgatgtaacctcgagtttctctctgaactctgaccacactgtagaaacccctaggaggaggtgagcagctctgtcaggcacagaattacacccagggaagaaaaattaattccaatactaagggagaaggctgtgttctcttgcatgatatttagcagcaagagcaaggagagggatgtttccttctttgtgtaatgtgcagtagttacaataaacacaagatttccaaatctcagaggactcttcttgacagttgcttgataacagcttttttcattccatagttttgacagtttgtgtgtgttgccatatctagtgtaaactaaaacatcactgtcattctgtttttcttttgtatgtggctttttttttttcatctttaggataatgaaaaagatgggcttttcacttgtagactagagtaaggcaagttgtgtgtggagattagcatgtgtttataagttttgaaagattcaagttgacagcagaacactgctttaaataatttttttctccatatcgcttcagtaaaagtacaagtgggatgtgtaagttttctcttaatcttttgataaatagcaaaccttaggcatctgtgtgggtacctatattatttatcggtggttattgaaaatgaatgactacaatgaacatctctagagctcctggctgtgtagcctttgataagtggtgagcatcctgtatcttactgttaccagggtcttgccctgccccacgtaggtgcttttcagtccctcgctatgcttcccttcacttgatggatcccctatcccacccacctctgtcaggtttatagctatgctacgttattggtttgtgtccaaaccaacaggatgatattgttgttgtggttgatgatttatctggagtaactctagaaactacattgcatctgcactgtttgagaggctgcagggcaggtgatgggccagaagcccaagtcaggatcagagcagtctttactcatcagatgtgaactctcagattccccaaagtcaggaagggatcccatacctgagagaccttcccccctccagccccaataacctttgatttgtagaagtctcagtgaggttattttgccatcaaaccaaatttgctgtagcatagcaaagctcccaatgccgtcatctggcatgttacagacaaattccaattacttttctacttcgagctattgttaaacactacaagctagctgacagtaaaattataaatacaggtgttgtcacactacactataatcagaattttaatttgaattttcatttgtaaagcctttttttcagatgaaaatgggaatagaattagttttattgacagtaaaaagacattttgaaagcttcctaaatcattacctgtatttagcaggaggaaaaattgtatatgtccatgtaaaaagaagagttttattatcacatatttactcattatatttggtggtaaataaaacggggaagacatgtttgacaaatgattgacggaactcactaggtttttgcttcatcagaacaatagacagacataaatatatattttgcttttgttttgttctgctattactaatgcagacctgtagacaaaatctgtttctagcaaattaagtgcagcctattgggagtctgcatgcaatgctaaactttttatttggcaattttctcttttcacccagattcatcatctgtggcgctctttttaccccttttgcgtggtggttggagtgggttcccccttctcaggtcccttttttttttccctcaaggcatttagtgtcgtgtctgccagatttcagtgatgagcagcgaattgcttttaaagtgggcattatgccagttcagcagcacaatggaaaaccaatcttccaccattctacttttgatgctgttattgtagcattttagataactgctgccacaaaaaaaaagaaagaaaaaaagatgtgctcaattgctaccagttagtcaagttaaatccagagtagcattaaaattactctgaaaactctttgtcagaggtcatgtgccgtctgtggctgccacacataggatggatgttctgttcaggtgggggtttttccctttattattactgtgactgaccagctctctaaatagccctttactacctgtttacttattgtcttcacctccctgttgaaaaaatgtgtcaagcagaaatgttgaaaagtttctttaaagtgctggaaatagcaggagagtgagtcgttcagggtgctagagtttgtacaatgtgaaagcaaaaaaaaaagtcgggggagagcaagaacataattctctggtttctatagcaagattactgttttcttctttttatcttcacttttcaaccactgggttcactgttctactttttttttaatagcacaaatggaatttatcttctctccatctcaagtccctcccctccctccactggctttgcttgtgaatgaaagggactcctactatgactaaggacagatggcagctgtatacgttgtatttgatgtattttggagtgagccatattttaaaattcagggccaatagatgggctattttgagagtggcactagcgccatcctttaagcctgctccatttcctccaaatttatttacattttaaaaattatataaataagctataatctgtgctcaaaataattgagttgtgatcttttaactgtattgcattaataataaaagcaactcagacttctgggctgcctttcttctaaagagtatgtgttcatttatctttatgttgtctctaatggatttttctcgtttatgttaatcatatctctagtattatcagattctgatcctaatgaaggcaggcacttttgtctgttttgtccattcctatgtcccagggcttagaatagtatctggcacgtagtaggcactcagtaaatatttgctgaatgaattaataattcatgtttctatgggtacatcgaattgtagtgtatttacttatttgtatgttttcctctccagctagaatgccaaactgtgctcctgaaatacagcaggcgtgctaaggcattttggaatcctttcttcatctctaccctatcccaaattgtacatgacacccagtcagtacttaataaatatttgtcaaataaacaagtagagaagcccaaacgcaatttatttgccagtgaaagatatggtcatttggtggtagagatgaggataggttaatggcccatcaatcagtattgttaagagtctccacgttcttagccttatgttaattcagagttctttcccaggtatcctattggttttctgggcttattgccaagcatattttagatccatattttccttcagtttacagtttaagagcattttaatttttgctaaagcttgcaaaaaaaggctctgataatgatgcagtcaatatcagtaaccatcccatttgctagtgccatctagatgaatccattgtgtagatcgtcctgtcttaatatgggagggagactgctgtgcatggtgggatggcctatagcagttagacctctctaagcaccatttgcctcttctgtggaattgtggtttagtcattctgtcgtgtcctctactacctgcctcccccaaaactccctgcttccgtctgcaaaatgaggacctagaggctgcttaacaaggccagaggcttcagagaattcagtgacttaatcaagaactgtactgtgtaagagacacactgctttccctttaaatcattgagtgtaagagacacaccgctttcccttttaatcattgagtcataaatgtgacatagctttaaatggatagcaacaatttgcaaatcaataagacccattttgtaattagctttggactaagcattaaaaagtatacattgaggattatggtagttaaaatgctgagcagtgtggggattcttccttggtagctgaaactgtgcataataaacatacagaaatgaggatggcgagtttcagttttaccacaaggttatgcatttatttgagaagaatctgagatgtgcaatacaacattccctaatatgctcatttcatcttctctgctatcattgaaccttcatctaagaagagccaaggaacaaactgaaataaggattcagatttttattagagtaaatgtaaacacatgtagaggggaacattttgccttacatggcctaccatcaacgttttacaccggaaaaaaaaagtgtgtgtttattccagcatcctgcatcaatactggcaaaaattctaaagacttgcagttgcttgggccaaagatggaaaattttatataagaatgctgaggagaccttttgcactttttttttttttttttttttttgagacggagtcttgctctgttgcccaggctggagtgcagtggcgcgatctcggctcactgcaagctccgcctcccgggttcacgccattctcctgcctcagcctcccgaggagctgggactacaggcgcccgccactacgcccggctaatgtttttgtatttttagtagagacggggtttcactgtgttagccaggatggtctcgatctcctgacctcatgatccgcccgcctcggcctcccaaagtgctgggattacaggcctgagccaccgcacccggcctgcactttttaagataaatcatgcaggctggagagtaggagttttgtgtgtgtgtgtccctttacaaagagagtttagaggaaagagcatgaattaaatttgtggcgttgtgaaaagcctctttggtccggtttcctcatggctatggtgtctcttctgtttaacttatgggactgttgttaggatgaaataagatatgtattttttgaaccctctataccaggagttggcacactttttctatgaagagtcagatagtagtttcagctttgaggaccagtctcctttgcagctattcaacttctccacagtagccatagataacacagaaacaaatgggcatggctgtgttccaataaaactttattaacaaaaacaagtggaagccgagatttggccttcaggccatagttgctaacccttactccataataatgaaatcatgaaacataaaataccaaatattctaataaccccccatttggaagtcagccattggagtcagtacctggccactcttgtacagtgtaggcctaaagggagtatctctttctagagaaagccactttccattgtttttagttcagtcttctcaatttttcactaaaccctctagagagaatttaaattcagttgaatatccttgtacaggttgaatatcctaaatctggaaatctgaagtgctccaaaatccaagactttttgagcaccagcatgacgctcaaaggaaatgctcattggagcatttcagagttcagattttcggatgttcagctggtgagtgtggtgcagatatttcaaaatccaaaacacttctggtcccaagcatttcagataagggatattcaatcagtatttatcagtggcttcactttggccacccactgtcacaaaagcatccagtcttttctctaagaaagggttccttccagccaggcgtggtggctcatgcctgtaatcccagcactttgagagactgaggtgggcagatcacctgaggtcaggagttcaagaccagcctgaccaacatggagaaaccccgtctgtactaaaaatacaaaaattagctagacgtggtggcacttgcctgtaatcctagctactcaggaggctgaggcaggagaatcgcttgaacccgggaggcagaggttgcagtgagccgagatcgcgccattgcactccagcctgtgcaacaagagcgaaactccatctcaaaaaaaaagaaagggttccttctttatgacagtttcctcagagccatgacattaatcagggtggagaagggatgccagtattaaaatagctaagtagggtggagcactgccacccattacctccactgggcaatccttgagtctttggttggtaagaagagttgaaaagagggacagtggctatgttagtgatcaaccagttaagatttcaagatatgtgagttcaaagctgcaatgagctatgaccactgcactccagcctggacaacagagcaagagtaagactttgtctctttaaatatatatatatatagtcaggtgaccggtagctcacacctgtaatctcagcactgtgagatgccaggagtttaagacaagcctgggcaacacagcaagaccccatctccacataaaaatgtaaaaattagccaggtatggtagtacatacctatacttccagctatgtgggagtctgaggtgagaggattattggagcccaggagtatgatcatgccactgcactccagcctgacagagtaagaccctgtctcttaacatatatatatatatatgtatgtatgtatgtttatatatagtcactttaaaagtctgcctttgactttattatcactctgctttctcagatttcttaagtccttaaatttctcccccactcttaggtgctccacactaagttactgagttcccctgtatttccaccagttatccagagcgttggccctctctgataggcagcttctaagatggcacccagtgactattatttgtgcagtggtcctcttcccttgggtatggcctggaccaagtgactctcttcttaaaaaggaatacagcaaaagcaatgaaatgtcactactgagattagggtacaaaagatgttgacttctgtcttgagcattctcactctctcactcactcactctgagggaaaccagctgccatattgtgagttggggaagcccatgtgatgaggaactggggcctcagttcagcaacctaagaggaatagcagtccacatgaagagaacttggaaatgatccttgccccgttgagcactcaggagacagtgggactgacaccttgattgtagccttgtgagaaaccttgagccagagatgcccagctcagccatgcttggattcctgtcccacagaaaccgagaaatgtatgtattgtgtgttatgtttagccatcaaatcatggggtgatttgttacacagcaatggtccactaataaaccctttaaagtgcaatgcttatttaagcttctgtttctcataacctgtttgacagtgccttgcatgtagcaggttatccacagatacttgtttactgatccgcttacactaaatgtatagtcatatgtttcattattattttgccagaatactgatttggcttaatcaaaaatgttcatctttttctccacaaggtatgtaactcaccatcttgaggtatggcatctgtggatccatgatacccaagcaggaagggaatgttccctacccgcaaacaaatacggaacccaagaaaggctgagtgcccctggaatcgttgtaactttatccttccccagtgtgcagaagggaaagggtgttacgagaatcttgccttcatgtcaggatttaggaaggcacgacctcttttctacactctatccagaatgtgatggtgacctggaatggtaagggccccaccaagaagacctgtttatagcacagctgttaccttcaccatccaactgtggcctcgctttagttccagctgtttatattagtcaaaactgtccctaacaccacagcataggctgtgagaacaagaggctagtgagaagggaagatatccagaggattaagaagcaaccaagccatggcctatgttcttttgactttatccccaaaagaacaacagcttagctgatggtacagcctttggcccaagaaatgtaaaagccattccttcaggtgcctatttgcatatttctacaccctgagggcttttttcttctcccacctgtggtaaatgactgtgtacactggactgtatttactgcctatctgttgtcatcattgtcatcaactaacatttgttgaccattaacatggtctcagaaactgcctgggcactctaatccgtcagcctgtgcattcattaaagtgaaggaaaataagcagaggcttgacattcagaaataagagcccagaaatgagtccagaatttccgattctaaagccagtgccaactcccaggccacactcactgcatttaatgcatatgcattttcttttcctcacatctgctcttcctttgcaagaatgtcccagcctgtgtacacacccatatcctgttacctctccagagtaaacgatttccagttcctgtggatattgcatgtcaccacataggattaaacagcctgaatttttttatgtgcccatctttagaagccttataagtagagattaagatgtttatcaagattagaaatgcggctgggcacagtggctgacacctctaatccagcactttgggaggccgaggtggcagatcacttaaggtcaggagtttgagaccagcctggtcaacatggcaagaccctgtctctactaaaaatacaaaaattagccaggcgtggtggcaggcacctgtaatcctagctactcgggaggatgaggcaggagaattggttgaacccaggaggcggaggttgcagtgagccaagatcccaccactgcactccagcctgggtgacaaagtgagactccatctcataaataaataaatagattagaaatggtatgtgagcaataaagatgttgtgtatgcttcttggatattgttgctgactcaagacttgaaaagactggagtcttcaggaagaatggtactggtggaaaatgttatttccataatatgaagttgtgaggtcatcaaaatcagacatacctaaaatttttatagtcctggttcttagttgaggggggcagtataaacttatcaaaatcttgggaatgtttaagaagcacaaacacatttctcaccttccttttccccacaaaaacctgtgagaaccaggttggatggtgaacactggttgaatatgttgacaaataaacttcccaggattcgacttgactctgtcccaaccccctaacccccctgagcaccactgacctgggactgatcatctccttgtctgtcatggaatattaattggacattaagatttttagattttttttttttttgagacagggtcttactctgttgcccaggctggagtgcggtggcacaatcacagctcactgcagcctctaccttctgggcccatctcccacctcagcctcccatgtagctgggaccacaggcatgcgccaccattcctagctaatgaagatactcagaatgcttccattttctcatgacttcatgtgtattaaaaagtagtgcttacatcaaatttcactgtagtcactatcccattggctttgattaaattacaagcttctgtgtagaatgccgtgaaaggtttttgcgaattgcagtaatagccatggggggtgggggtgggtgatgaacatgttttctgctggggtagtaactcagaactctaggcctttggtacagttgatccttaataagacttagtttcaggttggaaactgtttgttgaaggtcaacattttgttgctgctttttctgctcaaatgtagtatagaatcatgtggaggataaaattttgctagttgttcagcgtatccagaacagagttctggcagttaaggcgtacaatactcttgtatacctcaatgatggcgctttttaaacattagggtagttttaaaaaattgcaataaagtcattgtaattcatagaccatgctgtaatacagagatacgtgtaaaatacaatctgtgtacctgattgcaggtaacagagttaaatgtaccagcaatttcaaacacagtttgatatttcctataataaaatataatgtaaaaaattaaatatccaatatcaatggattctaaatggttttgatatttctttttgtcctttcccatgaagagtaatttatttccctttttaaagtgtgggcagaatgattactagcgcactgtaatgtaattgtgttgcattgataaaataaaaattgtcctttatctgtgtcctgataatgttcaatttacaggctggcttctctgccacctcttcagtgctttgagtattccagttctcctcccttcctgctctgagagcgcacagaactgtttgaaatccactggtacaattgtcaaatcaattattcattctctgcaattatgctcgcacaaagaacattttgctggtctgaatgatgattaaattaacagctattccagctgcctgataacatctaatagaatattcataagcccaaaatggaatgaattatctccattaacttcatcatgctcacttaattacatgcttgttattgtatttacaccttgttagataccgctgaagctgatccagtggctggccgggaattggaagcgtctgtcatggggcagttggagcgcgttttgtaggaaatgctatttattttaaatgctccacctgctgggagccgaggttagtcagcagcactgagatgaattgggaaacggggtgtaaaaagaaataatgtgcttctgacaggctccgtggcttttaagttgctctcattcagccacttcacaaaaaattattttattccatctctcagtgatgatgacatgattgctttttggtaatcatttaccattctgattttattttttgaagtaaattgtctgaagtaataggttcttggaattacagcgtgccttgcttttttcttagaactttatttaagcttgtcttccagcatttaacccgagtcccctctttcgtttgatcttctaactttatttatacaacagtgcttaatgatcctgcacaatgtgtttcttttttttttttccttctctacaacctccccccccacacccacccaaaaaaaaattctgtccagtatggttgacagtactttttataacctcagcaagggggctgcatgggcaattttcttccgacatgacaaatgcaaacacccaaaacccaaccctgagagaatcacttcatccagttgaaaggaaattttttatctctttcaaggtgactcttttgccactgaaacatggtaaggggcacgactcttaccttctattcttgtctatagaagtggcattctttacattgctttattctgtctcctcccttctcgcatcggcctctgctcttccccaaacttccactgaacaacccttcctggtagttgggccccatggcacctccatttgctttgagtgtgaagggtcactgttcaccaccaccaggctgcagcaagcctgtgtttattgaacatgaaccagaccaatggtggagagaattataatcacacttctaaatacttgtcagatcagcctacagcctagtagagcacttgagctaaaccatggatattttattcttcttgaaggctgtattttggtatcaacataaaagaagaaaaaagaaagaaaactgaagataattatttctaagtaggaatggaactggatagtggactaacagactcttcaagccttcagaaatattttagcatctaagatgtgatttaatgggtgagaatggtcctctaggcattggctaattgatagacacattgatcactgtgtgtgcctggcactgtgccttgtgaattttttttttctaaataagaattgactcaaagattatttcttttcatttcttactttgagaaatgtttatgtacttgccatttgatttggggccctaaatgtctttgagtttaaaatatggatgtcacttgaaatctttcaggtactgtgcatagccggaagctcagttatatggatcgatattcaggaaaaaggcaggccagaggctccagcagctctctgtaggtcggatggctctacgtgtagagagcgtagaggggtgcagttttctttcaaatttttctaaagcttcctgcattccaccccttactgcaaagctcacgttgcattgagggagggaggctatggattggaaaaggtgggagaactgagaactgtatggtgggaagccatgcaattaaaaaactgactgaaattattacctgatttcataattgacagaatatttaattcagatatagtaaattgacacacctctacacagagacaattatgactgactgtataacacctgacagaatcaattataactgactgttgtttgatacctttgtacagaaataaatgaaacagacattcagaacagagacggctgctgcctgtgtgcctaagcctgccttaattaaaagaaaataaccagtaggcgatgttaaaatgtctttgcctcgtggtttctagttcagtgtgtttctttaagtccaaaaagggttttataaagagtaaagttgaaaagagatttttggtttactgacatggaactaaaatatgtgaagtagagttagtttccttagatgggagaatactccattattttaatagagctagcattttatttgatcagttgacttttatataaaatatttaagaaaggtcaacctacagatgatggtctagttcatcccatatagaaaagaatgtaactttcattattttgaggttttagattctaatcaatagaaatcaacttttaaatgagcagttcattttgtagtctgataaaatattttgtgaataattagtatctaggctaccctttttttccatcgttttcataggggttagggacagaatatttttggtaattaacatataaccacagggaatcagagcatgtagaaaggatcagagtaaataagctttatatacacgttcctcgaatgttattctcaagaaaagtttaaaaaggagattagctttgctgatgtattaagatgagtgatttctgggtgatacttcaagccattagagtatatttcagtgacgcacttgtgtgtaggaagagcatttcctccccgatctcgacaaaggttggctttgtggtgctggtggcggagacagcagttaccagggccagtggcatctctgtggacagggatgggatggctgcggatcttctctggctcttgcctaatggcatgttggaatcttttaacagttgttattgggcacctgacctgcagcacctgaggtgatggcgtcgttactgataggctgactctcaaaatcaaagcaggaaaaggaatcagggttttactggccacattaactggcctccaccagttaacacctgtattttcccttgagttctaaagtggtggatatagtattgacagaaacagggtaacagtttaatgtgaggcctaacgtgggtggcccaggtgcctaaagggggaagagaaaaaccaggaaggggtgactccttccccccaccagcccctgtccctgacgcagcctgtgacagctagtccagttctgtttcctagaagaccttccatatgttattgattaaattctctttggggaagcaagtgggagcttttatctgcatctctaactggcgtggaatggtgccttggccgtattgactggctatgggatatgctggcggtcacagttgtcttttaggaggaagagcaccgagtgacgctggttgtcattctaactctgctgtgtggcagcgtaaatagtcccctttctaaccaacctggtgggaaaagtcaatatcccatcagcagaggaggtaaacacatcaggagctatgtcctctcttttcctcccctgctccgtattaccgcagctctttaaatgtgctctccccagtcatcagatgcatttgtgtcattcacatgcacggggttgctggcctgtggctctggcctgccgggaggcagccgacactggttggggccattgttgtttattcccagactcagatcattagaactttcaaattgtctttctgttgcagcccccctctctttttccaccccttttgggcattttaattctctataaaacctgtggttgttctttaaaggacaacttatgtaattcagaaaaggttgtggagagcaaatgcgaatgtatagccaagaaacaaaaatctggagtctgagttttcgttttccgggtgttttgtagacttcccgtgttgctgttgttggaggtttgctttctgtgagtggcgcgctctcccctccgtgtttccttcctgaccggttcctatcgggaggtgctgggcagccttgctgctcccaggccctttggcacaggccagcatcttatgggggcggaggcctcacctcaggatcagctgatgtctgaggcctgcaaatttctatgtgggagtagtgatgtagtggcagggggagtgggcagaagtgagcctctcctcaggtgcgggctgggggttctggctacctgggtttgcgtgtctacaactctgattacctgctgtgtaaccttgggtaagtgacttaacctcccagtttcctcagccatcaaatggggattgggggtggggggggcgcggggaaagcagcctctccagacaccttaccaggttcctgaacacagcgtcatcccccacgtgatcactctcttcacccaaaagatcagacctgagcatcacagccccactgctcctttaaaagaacaacatgtagggccgggcgcagtggctcacgcctggaatcccagcactttgggaggccaaggcaggagaatcacttgaacccgggaggcggaggttgcggtgagccgagatcgcgccactgcactccagactgggcaacaagagcaaacctctgtctcaaaaaaaaaaaaagaaagaaaaaaaacaacatgtagaagtagcaggctctgggaagggaaaggagaggggtcttttctctggctggtagcatcctgctcagaagggaaaggccagggatgaatgggttaaaggagcaggagtgccgcataccctgagttcacacagtgtggacaaagaagagcaaagaaatcttggccatggacagacaggtgccctcggggccgctcacctctcgcctctttcagcaaaggaaattttgtttagcagagggacttgggctggagggactagaaaatgcttactaggcccagctgatctggggagttggggctggaaggcaccagaggccatagctccctttgagactaggtgtttcctgccacgtccagacttcgcaagcagttgcatgcatgtgctcgcagcgccggtgaaagtggcgtctgcgagtagagctcaccttgtctgctgcacatgagggtgcacctgcagttcacatcagtagagggtggccctgtcccccagtgcactgagtcagctaggtgctgagaggcggacagacaggggaaaggaagaaaagctttcacagaggaatggtcggcgggggctgcatctgactggccccaggggtagaccagagataagatggtggagatacaaatggaatcagcatccccttctctggtggaatactgaatgttctttaaagaaactacctgagacttctaatctctctctctctctttttagataaattgaagaagcaattttttacccccaaagttctgcaggactacagaaaactcaagaacacagcagagcaattcttgtcccgaagtggctactccgaagtgaatctgagcaaactcttcgctggttgtgccgtgaaatcctaagggaatcccaggagtaaccaaggagggggtagttgaaaaatcccagcttcctctgtgcctccactctggccctaaatgctcctccagcatctgtttctcccttgggactgtgtctcatgtttgtgtgaatgtagaccaggaaagggggctgcaaaaatgttgagtctaatgttcgtaagcatcatagaaattcctgtcttcatattaagatgtactgctttaaaacacaactccagagcccctccccaagctcccctccccaagctcctgaagacccggtttctgagggagggaaattgctacttggattgagagtagctggaatgtaagtgaccccaggctttgcctcagggcctttagcctatgtcccccccacataaagagagcttctcagagcctgactgaagagctgacgttttgctttttcatatgccaattaaacccggtctaaatccaaatgcttctccagccatccaggagtggctgtccttttcagtcttgtcttttatataggtagctgagggggaagatttagaagccttgcactcactaaatagattaaacagagcaggcttgtttgttgaattgctccaaagtccaacagacacacactgagcaggtgttttacactcacattccctttttgccccttaaatagaaagtgcaggtaaaggtttatacaacaagaaagcacattgaaaataatttgatactctaacaatccattaacatgtgtaggggttacggtgaggatcactgtgttgtattcagaaaaacggggagagggatgcttaattggccctggcgcttgctatttttttctcatttcttcacaataggaccgtctttggcagcagcaaaatgtatttcagtatggcagtctttcctctcttacattattggtaagattatactaacaaaatgtttccccttgtacaattatgctgtgtttttaaaaaacattgacctgtgtgtttttataaaagaaaaagtatgttgtgccttcttcttaagaataaagttttctaaagggaa

SEQ ID NO: 1914 - DNA, 63598 bp, Homo sapiens
gaaacttcagtatgaaatacaaataaaaacaaagtgtagcagcgatggcctcagacagtagatggcagggacaaactaaggctggctctgggccaaagacacgagcctcctggggagcctgtggggccccctccctcctgtgaggctctcgtctggggtgtctgcatttctgatttacatttcatacttgtttggtgccctgtgaaattggcctttcttctttctgcttccagctggtcctgtgtggaggtgaaggacaagggctgcagtgagccaaaagtgaggtgcacagaggtcttgttttcctgaggctgatagagggttccctctagacccggctccaaataagcagggctcacaagccaaaatccagattctcacgggttagggtctggattcctggggaaaccagcccacaaactgctcctgtgaggctgtggggccagcccatttctccatgcaaacaggtgagactccagccccaccagggccttgggaacccgtctcgtctcagagcccaatctcagggagccagaagcccccaggggcttttcctccctctgggaggcaggacaaagaactaggggcacctagaggacgctcccaccccaccaggtgtggtgcaggaagcaacagaggcctggaaaagcattcactgcgtgagaaacggcgcccagggcactcgcagcctcgctcacggcctgcttcttcaggtgctctggcgaggccagggccacatcctgctcccgctccctcctgtgacgtctgagctccctgaaaatggttttctttggtttcctccccgttccctggcctggggtcacaggtttggacagtcagggtggtcagtggtctggtcactggaagcacggggatgtggccttggcatcaggaggcctggcacggacgcagaggcacccggggcccggggctggctaatggcccagctgtgggttcttctgcagcagccactccagggtctccaggaggtacgacatgccgtagtgctgggcaatgttccggaatattccgatctgttccatgaagacctgcaggaataaacaggcacagtgagaccccagtccactcagagaggaggccaaggaggccaggctgagccgaggcagatgagggagagcccacctgggtgtggatggtgagggcgaagtctcccgcgcagctgcagtacacaggcatgctggtctccttcaccccgcggcacttcaggcagacctgaaagggagcagccccgatgggcgccagccctcccgcgctggccagacctgcctgctgcttcttcacaggctcgcgagacacattcgtgggcccatcagtaagcctcgagcccctgctgtgtgcagccagccctcggttatgagtaaaatgcacgacctcatcccacggtgccagcgccttccctacacccaccctcgctgtggatgttccaccccagatgcccagtcctgaggcctcctccaggccctgctcactccctccatcctgcaggcctgaacgccgtgcaccaccacacggcagcttggcgcgtcccccagcctctgctcagatgcccctcggcaagaccttcctgtggccgagctgtgcaactccctcttcctcctttccttctcttcacacttgggagtgtctgcctccttccgctagaacgaagcacccacaaggccagctcttgacccaaggcaggtgctcaaccagtgtggacagaacagtccatcaggctcagggcatggactggtctgcagggcaggccccttggaagacaccagggcgtgcctcaggacctgcacacaccccggctcccgggagtgcacagaaacccccctgtggactccagggcacacgggcaggcggcatgcacgactcaccaggtcctgcagggtgaaggccatcagcttcttctgtagaacttccaccagcgtcatctcgatggcagaggagtcgtagggcgcctgacagttggagcagagccactgaggcaggaccgccccatcctaggcagagcaagagtgcgagaggtcaccagcccagcctccagaccacagtgccatgggcaggatctcaggagaggaaggggctgtgagaagcgcctggtgacgggcgagtctcctgagtgcagctgcacgcactctggcctcccacctgcacttgagcccttcctaggacaacattccgaacatggtgtggggaggcctgggaaggggcctgttgccaatccatgtgagtcagaggggcagcaggtgtgacccacagagctggagctgcagaagccctcaagacaccgcagtgccctcggatgttctgctccacagtgaagggcccgctggagctcagccgcacctctgagaaggaagagtctttacacaggtccaggtcgcggcagaagttacagctgcggcagatgacctcaggaagcacgtaggagcggcaggggtctcggaactgggcctcctcggagaactcgccgacatccaccaggcgaagcaggtctcggttcagcttattcacctggtttgtgatgttggtgtccagggacagcacctgcagagaccacagcccacatcgggaaggagctcccggggcctccctgctgctctgtctggaccagaaccctctggaccttaggctacagtttcctggtgtcctttcctcccttccttagtccctttagacgcctcagctgacttctctacattagcagttttccatcggtgaggacaggcttccctggggaatttactaaacatttaaggaagaaatgctgctgattctacacagtatctttcaaaacactgaagagagagagcactcaacccattctatgaggccagcatcccctgatactagaaccaaagaccgtactaagaaactacagaccaataacagcctgagcacagacacaaaaatgcgcaacgagatattagcaaattgaatgcaagatcgaaaaaaagaatacataatccagaaagagactcacatagataaggttactaagttatggaaaaaggtacaaagatgattcgatagaaaaagaatagtcttttcaacaaatggttcttgaatacaagcgtatcttggagatatggcaagttcggtttcaaaccacctcaatggactaacatcacaataaagcaaatcacacaaattatttggtttctcagtgcatataaaagttacatgatttttggctcacgcttgttttctcagtacatataaaagttacgtgatttgtggtggctcacgcctgtaatcccagcactttggtaggccaaggcaggtggatggcctgaggtcaggagttcaagaccatcctggccaacacagtgaaaccccatttctattaaaaatacaaaaattggctgggcatggtggcgggtgcacctgtgatcccagctacctgggaggctgaagcagggaatcgcttgaacccaggaggtggaggttgcagttagccaagattgcaccactgcactccagcctgagtgacagagtgagactccatctcaaaaaaaaaaaaagctatgtgattttttttattttgggacaggatttcactctgtcacccagaatggactgcagtggcacaatcatggctcactgcagcattgacctcttggggctcaattgatccttctacctcagccttcccagtagctgggacgacaggcatgcgccaccatgcccaggtaatgtttgtaatcgttgtaaagatgggttttgccatgttgcccaggctggtcttgaactgctgggctcaaacagtcaacccaccctgacctcccaaagtgctgggattacaggtgtgagtcactctacccagacaaaacttaggtttaccctatactgtagtctattaagtgcataacagcattatgtctaaaaaacaatgtatgtaccttaattttaaaatgttttattgctcagaaatattaacgatcatctgagccttcagtgagtcgcaatcgttttgctggtggagggtcttgcctcaatgtaaacggctgctgactgatcagggtggtattgctgagagttggggtggctgtggcaatttcttaaaacaagacaacaatgaagtttgctgcatcaactgactcttccttccatgaaagactctgtagcatgtgatgctgtttgataacatttcacccacagtagaacttctttcaaaattggagtcggtcctctcaaattctgctgctgctttggcaactaagtttatggaatattctcaatcctttgtcatttccacaatgttcactttcatctcaagaaactactttttggccaggtgcggtggctcacgcctgtaatcccagcactttgggaggccgaggtgggcagatcacaaggtcaggagatcgagaccatcctggctaacatggtgaaaccctgtctctactaaaaatacgaaaattagccaggtgtggtggcgcttgcctgtagtcccagctactcgggaggctgaggcaggagaatggcgtgaacctgggagggagcttgcagtgagccaagatcgcgccactgcactccagcctgggcgagagtgcgagactccatcttaaaaaaaaaactacttttttgggctgggcgtggtggcttgtgcctgtaatcccagcactttgggaggccaaggcgggtggatcacctgaggtcaggagtttgagaccagcctgaccaatatggtgaaactctgtctctattaaaaatacaaaaattagctgagcattgtggcgggcacctgtaatcccagctacttgggaggctgatgtaggaaaatcacttgaacccaggaggcggaggttgcagcgagccaagaccgcaccactgtattccagcctgggcgacagagcaaggaggctccatctcaaaacaaaacaaaacaaaacaaaacaaaacaaaacaaaacaaaaaactactttactgctcatccatgaaaagccactctttatctgttaaattttgtcctgagattgcagcaacttggtcacatcttcaggctccacttctaattctagttcccttgctgtttccaccacatctgcagtcacgcctcccacaatagtcttgaatccctcaaagtcatccatgagggtcagaatcaacttcttccacactcctgttaatgttgatattttgaccccttctcccatgagtcacaaatgttcttaatggcatccagaatggtgaatcctttctagaaggttttcaatttactgtgcccagttccatcaggggaatcactatctatggcagctatagcctcatgaaatatatttttaaataataaacgttgaaagtcgaaattgctccttgatccatgggctgcagaagggatgctgtgtccgcaggcatgaaagcaacattcatctccttgtacgtctccatcagagctcttgggtgaccaggtccactgtcaatgagcagtactattttggaaggaatctttttctgagctgcaggtagtggccttaaaagactgaatgagcagtggcttcgacttaaagtcaccagctgcatctgccgctaacaagagtcagcctttcctctgaagccaggctctgaggcctcctctctagctatgaaagtcctagatggcatcttcttccaaaagaaggctgttttgtctacacggaaaatatgttgtcagtgtagccaccttcgccaatgatcccagacagatcttctggagaactcgctgcagcctctccacccgcacctgttgcctcatttgcccttttatgttactgggacggcttctctccctaaaccccatgaaccaacctccgccagcttcaagctttccttctacagcctcctcagctctcagccttcatggaactgaacagagtgagagccttgctctggattaggctctggcttgaggggatgttatatctggtttgatctatccagactcaactttctccatatcagcaacaggatgcttcacttctttatctttcatgtgttcactggaggagcacttgtaatttccttcaagaacctttcctttgcagttgacttggctaactggtgtgagaggcctagctttcagcctgtctcgactttcaacatgccttcctaagtttagccatttctagctctttatgtaaagtgagagacgtgtgactcttcctttcacttgaacacgtagaggccattgcagggctattaacttacctaatttctatagtgttgtgtcaccgggactggggaggcccaaggagaaagggcgagatggcagaatggcccgtgagtggagcaatcaggacacacacaacattgatgaagctcattgtcttctatgcgcacggttcatggcgccccaaaacaattgccatagaagcatcaaaggttatcacggctgatataataatagtggaaaagtctgaaatatcctgagagttaccaacatgtgacacagacacagtgagcacatgctgttggaaagatgagacttgctcaagacaagattcccacaaaccttccatttataaaaatacaggtaaccgcttcgaagcacaataagacaggatatgcctgcaatcagatatcccatgcagaaatatggacttggatctacagcatgcacattgtataaaaattaactcaaatggataaaacctaaaacttcaccaaagaggacagacaccaggacagcaaagaagcccattaaaaaatgccccacagccaggcgtggtggctcacgcctgtaatcccagcactttgggaggccgaagcaggtggatcacttgaggtcaggagttcgagaccagcctggccaacatggtgaaactccgtctccactaaaaatacaaaaaattgggggggcgtggtggcaggcacctgtaatcccagctaaccaggaggcagaggttgcagtgagctgagatcgcgccactgcaccccagcctgggcaatgagagtgaatctccatctccaaaaaaaagctccacatcattagtcgccagggaaatgcaaatcagaaacacaatgcgataccactacacacctactggaatagctgcaatttaaaaacccaatgataccaagtcctggtgaggatgtggaacagcaactcttgccacacactgctgaggagaccctgacacggtgcagccacttcagaaaagagtttggcagtttcttatcaagttaaacaaacacttaaaaaatgacctcagagaattgaaatttatgttcacacaaaaacctacacctacagaatgtttacagcagctttgttattaatcaccccaaagtgaaagcaacgcaaatgtccttccaccagtgaatgaaaagcaagctgtggtttgcccacacaatggacactgctcgcaacagaaagggagttctgatacacacgagcgcgtggatgaaccaattccaggtgtgttttgctaagaagccacatccaaaaggctgcacaatgtctctacttatgtgacgctctagaagagaaaaaaaatgcagggacggaagacacaccagtggctaaagggtgtcaggtgaggagggcagtgcggggaatgttttcgggcggtgactatcctgtatcctgctgatgatgatgcaattccattcacctaggaaaaatcacagaactgcacgccacagagtacattttactgtatataaattacaccttaataaaaatgaatttaaaatatgtaaaagtcaataaaggaattaaaatggtgagctaaaaacacttcttcaccacaaccagaccttgaggctgtcacctgatctccagcgtaaccttagccgtgtgtgagatgcagtttgctgggaaggctgagtgaggaaatggacagtgaagcactctgctctgtaagggctgacacccgcggtcgttatctggtaatattatccctccttggactcagcctgcctttcccagaaaggcctcagcatccgagcaagctctcatctcatcagctctgggtcctggtccagcctactggtctccggtgacccatcctcccagccggtggcactgggtgttcggctgtgccttcaccaacacaccaagctcaccccccagggcctttgcgtcttccctcctcctgcacctggtcccagcgcccctcacaggctccatccccacagcacctgcgcctctgaacggccctctcccttctcgggtcggctggcagcagacaggccccacaaggcaggacctttcctgtcttgctcacacctgagcacagatgccgcaactgtggctgcatgtgacagggacatgataaatgttggtggaatgaacaagtaacttacacctgctcctcaccttgcacacgctggcaccctgaccctacacatgtaggtacctcccccttgcacagctgaaagcctcatcctgcattcattaacatccttaccatgcacaggtatgtcggtgtccttatcttgcacacatacgctagcacgttcatggtgcacgcattacagcctcaccttgcacacagtaacattctcgccttacacatgtacgttagtgtcctctcctcacacgcacgctggcactctcaccttgcacacgtatttgatgaactccagggcagggttattgagcagcaagtgggaaccggggaggacaggaaacatctctgagagctcagtggagttccgagagcctgtgactttcttctgaatcttctgagtgatggtgaagaagctctgagtgagctcatttgcgacataatcctgagagaaggtgatcattcctggaagtataaggatgctgagggaggggtctgggacctgtctggcactggggacctcccacctgggggactggcaccggggaccacccatggcacacagaggagttaggtcactggcacatggcagtggcctcaaaagacaaaagactgctcaccgggaagggctccgaccgccccctcggcctcctgggagagctggctggcccccctcctcctcacgggggtgctccctggagcactgcgcctcagcccgtccttcatgcagtggtacacggccacgatgtacgctgtggagaggcacacacaccacaggccctgagtcgggctgctgcaaacaccctagaatctgaggggacccatggctggtcagattgcctcacagatgaggctaaaatgtcattgttaataattttatctgcagcctttagatgagctaaaagtaaattagagaagtgagaagtggaaatgagaaggaacactcgctgacacctgagttcattgtcagagagaaaactgtataaatggggccatgtacactaagcctctcactgggtagcgcgtgaaagacagctcccaacacaagcaaaggcagggcccctggcatcagcaagcttctccaaaaactactccgggcctgtcacctggcacttacccttttttttttttttttttgagacacagtttcattcttgttgcccagactgtagtgcaatggcgcaatctcagctcactgcaacctccgcctcctgggttcaagtgattctcctgcctcagcttcctgagtagctggtattaaaggtgtgcgcaccacacctggctactttttgtatttttagtagagatggggtttcaccatgttggccaggctggtctcaaactcttgacctcacgtgatccacccgcctcagccccctaaagtgctgggattacaggcatgagccactgcgcccggccaacccggaacttttcaaaagagacatagaaagttgcaagagagaactgagaaagttaaagactcaaggacaagtagacaaaaatataaaatgatcatcaacgaaggcctctgtgaccgcatccacctgtgtgtgcacatcacaacctgctgtttttacttagggcattctttaacttagggctgtcaactacaaacagtgcttcctcgatacacttcatctgcacactaacctgcatagcttgatttgcaaactctaagcctgcagacccaaaccaaggcataggaactcccccaccagaaagttaggcctcacagaccagccagggggcagctgacctgacccagggctttatcttcagctactgaacgtgcacacacacaaatgttccctgggaatgtatgtgactgagttaccgaatcagatggcgggagcagagctaggaaactcctcaatgacacggccaggggcagccgctccccatggagtttcctgagagcaaaggctggagggaagacagtcacccctctccgggccctccagtggaacatgcctggagcctggagaggaggcccctcggctcacaaagtcccaactgctgggcaggctccgcccgatctgattttccctgtctcccttcttgcgataccatggcacaggagccacatctactaaccatgagtcccttcagtgggggctgcgcagccctgggctctgggcttacctgaaacaatcatgaggaagtagttctggcaggaggctgcctgtggcaaaaactgcaaaatgttccagttgttttccagtaaatcctccacgttggattcctccgcctcttcctcctcctccccatctctttcctcctcatcgtcctcattttcctgctcatcctctgctccccctgctttctgggagtcttgctgtaacacatgagacaacgcggctgtgtttgcaccatcgcggcctggtagaggggtaggatgccacagcgaaggctcctccaacctgggtccatctgccccgtttgaccagaggccttcctcgcagtcaaggcatcccctggagcctgcgtgaatcccccagggtggctcccagtacaaagtgctttgtgggaagcgcctggcacacagaagtgctcgtgacctgggactgtgagcttcactctgctcttccagagttcactttaattgttgaactcccaccccccaaggacgaaagaaccagccagagcttcccggtgactgttctctcctctgagtccatgaatctcctgggacggcacgaccccatcacagacccagcctcccgcgcagcctgtgttcgtgccacggcaccatccacgtctgtgtagacaccgacacccactgccacctgccctgaccacacgctgatcccctcctcagagcggtctacactgcctgagtttctaccctcccactttgttctgaatcccttcaatcagggtttatcccccaactccaaccagaatcgctcccatccaggtgtcctgggcagtcttggcttcatcctgccagctcccagaagcgtctgcgtccttacaaagggctttccctctgacatctgagcccctggctctggtacccacagcttcctctcagtccactatgagggcccctgtggaggacacaggcctcctctcaacccacccagccactctctggccactcctgcaccagctgaccacccacgtctcaaccttgcaaacaccatgagccccagccagacgtgaccccttccccagactgctcccgacagccacctccactcacccacagcctggcccgcacctgggcatttacacacatccgatccgctggccccttggctccacttcaaagcccacccaggcccttctcaccaacctcgctgcccagcatctccctgacacaggcactaaccggctttacctgcctgtgccctccaatggtgggttatccacatggggccaagaaagctccaacatcacccacacagaagctcccatccccacgaaagccgaggccctgccctgccatgcccaagttgcctggctctgtcagctctctgcctgcatctgcaaccactgctccactgacttgtgctttgcctccctggtgtccatccgctggaggcgccttatgctcgcacaactatggtgcacttcatcagctctcggattccctgtcaccacctcatgggcctccacctccctgttgcccacggcaagccttgccatcaccagggctgacgccacactccacactgacgtgcttgtctgcgcatggtccctccccgtgttcatgagggcaggatgcgggtgcagtgtctgctgctcacggccaggcccgccggggccctgagcactcagcacttgctgcaggaatgaacgcgacccccaaagctggctcgggtgccacactgcagctcgcttaccagtccacagtgaatacgagatgaaacttttcctttgattccgccatagttagatggatccatccagagaagaaattcccagcatcgagagaaagaaattgtcagagaatggaaggtctcctttgaatggatgctgcagaggaagcattgaagacgctgcttcagtgaaatcgaccttgttctcaactttcctttatttccccttgtatctatctgtaccctccacttacttaacactgaatttgaaagttcattcagaccacatcatccctcaggcttcctggggaaatgtggtaaacgtaaaactaaggaggcccaccaggcccctgggagctggcgccacaaagagagctgggtgcctcctcgtgctggggatggcccacagggtgttctgcctctgctctgcggccttaggtgacctgcacctgctggtaaccaaccacagtgcttcccactgccaagctcttttaagctatcgtcatccttgtcactcctcggttaagcctccctagcgctgacccaatcctctgcacattagatccatttaaggaaaaaaaaaaaaaaaaaaaaaaaaaaagaacaggccaggcacggtggctcacgcctgtaatcctagcactttgggaggctgaggcaggaggatcgcctgagttcaggagttcaagaccaccccaggcaacgtggcaaaaccctgtctctacaaaaaatacaaaaattggctgggcatgctggcatgcacctctagtcccatctactcagtgggctgaggtgggcagatagcttgagcccagagtttgaggccgcagtgagccatgactgcaccactgcactccagcctgggtgacagagcaagaccccatctcctaaaaaacaaacaaaaccccaaaaaatggaagaataaacaaagaaagagaggaaggaaggaggaacatcctaaatcacagtttcaaaatgcagctgagtagcccacatcgcagctcctgcaggagaactttatgttctccctaactctgctcttcgcgctaaggaagaatagcagcctgtttctcgacatgagcaaccccggcctcctcaggtacagggcacccctggagctgcccatggccaacgtggggagaggcacatccttcccattatctcagccatgctccgaaatacaattctagcccaagccagctttcccaggcacacagcgtgaccactgaccatcaaggctcatcttggatagacataaggggccacagtgggtctgcaggaggacaacagtgcttttgtgtttcaaattaatccagtgcatatggtttgattaggaatgaaagtcttataagctctaccttcctacttctcagtgataaggcctattatcaatttagtgtcagccttttctgcagcgcccccagatgctacccctgtaaccatgcaaagatcagacccatgcagactctctgtgcctccacaagcaactcccctctgtgctcagaaagggctgcattcatccccagggtgagcgcacctaggagggagcttcctactatcagttgaacaaaagttgctggtggagatttttctgttgctttgtcttctatttagatttaaatagtgctgagtgtgtgagaagcacagcaaggcctaggagggaacctcaggaacatggcctggaaggcaggaagtcaaaaccacaccaggctctgacagctgagagctgtgcacacctgagcacccgggaaccacaccactccactcgccaacactgacgtctatgaaaaggcttacaacgtcaacacttacggggtgcatatattcagggcaccttgaatctgtgccctgaatatccatggggaaaaaaagcaaacaaacaaaaatcactgtggaaccttcttagcaaaggcaggccacttcctgaacttgcccaactcaagctgcacagctgagtggcctccgatctgctaccgcgcacaggtggcggtaacccccttttcacgctgctcagattcaccatggtgagtcctgcacttctaacgacctcccagcccacccaggaggagagctggcacctcagggggtcattttagcatccctctcaaagccacagtgctgcgtcaccaggaccagccagccgcacctgctggtgatgtactccacgtaagcgatggcatcttccacacggcgcttctttgtacagaggatgatgcggttgaagttggcgtagatgactgatgaccccaggcgcttgaactcagcgatgagcctgtggagcaagttgagagtccgtggtggagacgccacagtcatggagagccagagggcacccagaaaatccaagagggaaaagagctgagggtcctgaagcagaaaagcctccgagatacactagaacccagaagctaatgaagagcaaagatttctgcatggcaaaaatccaccacaaacaaaggcaaaagataaccaaaaacaggaaaaaattagcaaattcttatcacagaaaaatggcaactttttgtatggagacaactcattcgatatttaataagagaagaaccaccaaaactacagaaaaatagacaaaggactagaagagaaaattcgacttcattcattgtaagaatcctaagttaagactgcaccaagaagcacttttatcccagcagttgggtaataatccccggccatgttggtgaggcgcggccagggaagaagtgtccacaaggggcctctgtggggccgctctggtgaagtccatcaaatcaggattcatcccgagttacaacacctctgaggcctgcaagagggctacgccccagcaattaccccacggatctatctgcatgagctcatgcatgaagcctctcactgatttgctatttgtaacaacggcacaaggctggagagaggctaaatgttctttcatatggcatgtcctcacacagatctcctgacacaggcatattttcactaaaacaacaaggcacacagcaatacaatgtgtagcatgactttgtgcaggaaaggggcaggagaggaggtgccacctagtgttctctgcaggatgtgcaggcgacgctgcagcagcagctgcgtgtttctctgggatcctttggattgttatgctccacaaactcagaaatacactacttatcccagaggcactggctggccatgtctctggttctggggagtaagggaccagcccagctgaggacgcggtggacagcccagggaggaggagcactcactgcaggaagagcttcttcatcatgttgtggagtgtgcggtgcagggcagggtcatgaagcagagaggatggcgaccgaagccagcggtagaagtgcatcacctggttgtctgcatagatgttgtggtactgggtgatctccttcacccagcccacgaccatgctcttcaggatcctgaaagagaaggtgcacgacaccctcgtaccctcagcctcccacgctgctgccacgcgggacgctccaactgaaatgggcacaggttttccctacacggctgggtccaaatccgtcactgtcgcctccccttctcactgtccccaccttaagtcacggtccaaatttcatcccttcaccctcatgcctcatctgtttcttcccatttcattccttaaacttgttcaggcttcaccgcatcccaaactctgtgtgttctaaagcaggacgggagggcagcacagtacaaagcagcaagtgtgtgacgggccggggaccctgacaggaaggacacagcaaagccactgcctagacatcagaacaccacactaggccggatgcagaggctcacgcctgtaatcccaccactttgggaggccgaggcaggtggatcacctgaggtcaagagtttgagaccaacctggccaacatggtgaaaccccgtctctattaaaaatacaaaaattagctgggctagtgcatgcctgtaatcctgctactcgggaggctaaggcaggagaatcgcttgaacccgggaggtggaggttgcagtgacccaagatggtgccactgcattccagcctgggtgacagagtgagactgtctcaaaaaacaaaaacaaaacaaaacaaaacaaaacaaaacaaaacaaaacaaaacatcaccatacccacatggccccagctggtcagaaacaagaacttagaggcctctctcccgcctagcaggctgggccctgccttcccgccacttcctttaaatggaccattcaggcgctcgcccgtgaactaacacatgcctacaccccattccctcacacgcctagctgccctgggcaccctccctgtctgactcttcagtcctgccttgcaggacccagggatggaggatggcctccctactcacggcaccctccctgcccaggagctgtaaggaacacatctttgcacttgttccctattgtggtggtgactgattttgtgccttccctctgaagaggcaggggctgccctgggctgggtcttccctacgacactagggggaacacaaggctgggcccctacaccgaagcaatggtcaggcaggtggtacctagacacaggtcacacaaaagccacaagggcgtgtgccagtgtaaacaagtttcccgttccggggggccctggtcacaggccagacagctaggcattggccagtgcactgtacacgccctgtctggcccccttcacttcccatggggcagagatgccagctgctctggtactggaaccccaattcagctaaaggattccaaaactgcacatcaccctactgaagaagcgggaacttcaatggggtcaagaacagaatgttacaagagaacctacagaggtccaagtcccattcctaaaactccctttcatcacaaactcttcaataatttggcaaaccccacattctccagagcggcagtttgggtatctgctgttggactccttctacctttcaggcctgggctactgtctctctgccaagaccctgctcccggctcccaactgcctccctgcctctttccaccagtcctctccctgcctcatttcccagctctggcatgctccctctccccttttgtatggagtcattaaaactacagctgagtacaggctctggaattacaaagacttgtttttgagcacctacccttccattcatttgtggtatgaccacaaaggcagcccctctgacctcagtttccttatctgaaaaacagacaataaccgctccccgtccctgggctgatgtggggacagaggcagaatgcgaagtgctcggcccacctcctggtacacagcaagcattgcccagcatgaaccaccgctggtgggtaatgcgagtagctgccctcaaccatgctctccgcagactgatggctcctgaccctcaaccacgccctctgcagcagaccgacggctcctgacacctaagtgctgatgcctcacacatcatactcagtagagctggctggagatccctgtgatgtacctttggtcacatcgaaaagtggccctggttagaaagactctgtgtgaagtacctctggccacagggaggtcagaggcagcacactgaacagtcgccagggaccaggccggacccccacagtggtaaagacaatagactatggaaaactcgccacacagtggtctctggctctgccattaagactaagggaagcccaatggaccctgtcttagaccttagctttccaaattaagggcaaaggataagacccttctattagtaacactccttcccagagagggtggcacctgaaggtgttagagcacagggctgtctcatcgtagctggccggggcactggcagcctgaccacccgtgatcatgtcctccagggaggcctgctggatcacgtcgaagctgatccccatgctgtcggccccctccatgtcgttgacatggtgagactggagaatggtgttgacggccaggttctgaaggtccagctccacacacactgcacaggaagacgccatgctcagccagcatcctgccagctccagcaccaccagccccctgggcctgactccagccaccaccacctccagaaccagcaacagacctgcccacacccatcctcacacctgccaggctattcagattcccgagggcacaggaggccccacctggaccttgaccccaggaccgtctcctgcagcctcagctctgacctgcgcggtcgaactctgagcccatcctcggcactattgccttgagaagatgtcacagaatggcagaaacaccagccaggtctcatgggcctcgtcctcccgcccacttacctgtggagtaacagcctgaactgttgatctcaacagtggcttggtcatcgaactccatgacaagacagttgtcatcagcctcctttccacccaggtcagggcgggctgtaggggacagccagagcaggtggttgtggcgctggaggtggcgggcaaagaagaggtcggagccgaatgtggagatgtcctctggtaggttcccaatgggaatgtgaaagtacctgcaccagggcacaggtcagcaccggggcacatcgccgggtcacagagaccaccgaggccggctctgcctggggaccactggcccacaacgacagtactgtgctcacctgctcatctcgaaggcctgcgacaggcaggtgtccaggttgaggtagtgacggatcatgcgccgggctccatggcgctgccagtccaggaccccatagttgatcttgtcagccacacagataggcaccagtgggaattcctccaagacaggaatttcactggccagcctcttcagctcccagctggactgaacagcgatgagtgtgggcccccggcgctcctcctgggtcaaggcaaaatggaagaaaagacctgggtggacccagcctcaaagaagatggggctcacacagcaagaccccaaccactctcaccttgtaggcgagcaggaatcgctggatggctctgcagatggtcttcaggtcagtttctgcccgaacttcgaaggtgtgtttggggggtggcaggagctcagggcccaccttctccaggaggaggccgtgctctgctgagtacagggcgccaaggctgggcatctggttgctgcgcacctagaccaacgcaggccacgtcagcctccccctgcgcaggaggaagtgggggcagccctggggcagactccaccactgccacggcactgccaattcaatcacgacaagcactcatgggcaaaggcccttgaggacaagacctggagggcctgggcaccctgggagatgtcctccttccccaaaccctgccccagccaatgtgctgccatggagggcccaggactcacagtgtccagcacaaagacggatgccctgcgctgtgaggggatgaagatcccgaagagcgctttgtgggcctgtgcgtggtggtacaggtagatatggcggatactccctggagaaggaaacaagaccgtcaccccagatgtgtgggaggcaggcacatgatgggcggctggtgcaggccatacctggttccaggtagctgaactgggccagagagcgcatctccaggtgctcaagagcaaaggtctctgcttcccagcctgaaaggtgcctcaccagctgtttattgaccacacacacacagcccaggtgcaccagggcccggaacagtaacggaacctggaagaatcgggcagacaggccggcaagggctggatggtgggggctctggctgcccacgtgacttctgcccgggatgtggctgtgcccctgcagctgcccggcccactgcccaaaggccacttttggcagacacactgctgacattcacctcacctgtgggaacgagtccactgtcgctgctgttccccagcccacaccctgggcgggtttctttcctccataccaccctgctggagcctcccccagttcagtcgagggtggctggggagtcacctgagtctcatatacgccctcgatgtctggcgctgacagctcagcgttgatctcgttgatgtgttcctggtacatgtcctctggcactgaatactcatagagattgtagaccatgttggagcgaggaaggacccgatttacctggcgagaatacgacgatgatctcgtcactgggcgtaagtggtaatgtctgtggtacacacacaaagcacacgctattcggagtcctagacttctggtgcccctagcgacggggtacacccaccacgccacagtccacctctctcaatgattacaactaaaaactctggatgtaatttttatgttatttatttattttttacagacagggtcttagtctgttgcccaggctggagtgcagcagtgtgatcacagctcactgcagcctccaactcctgggctcaagtggtcctccagcctcagcctcctgagtagctgggacaaggaacacaccaccacggatggctttttttttttttttttttttttgtagaaaggaggtctcactatgaggcccaggctggtctcaaactcctggactcaagtgatcctcccaaatcgctggaactgcaggtgtgagccactatgcctggcctctggacgcaattttgaaaagcaacctgcagcctctgagaatagacaagagctgtcagaatacagcagtcaacactgatctggggaggttcccagttcatcttcctccattctctcatgggtttaacctgagggtgtagatggcaaaaactgagagaaatcacattttcctagtcagagaaacggaaagagagcccctgggggagccagagtgtgtgtgtggggtcctggggggctctgggagagctggagaggggcaccctagcttcgtgaatggggtcctggaggggtctgggagagctggagagggggcaccctagctccctgtgtggggtcctgggggggtctgggagagctggagaggggcaccctagctccctgtgtggggtcctgggggggtctgggagagctggagagggggcaccctagctccctgtgtggggtcctgggggggtctgggagagctggagaggggcaccctagcttcctgtgtggggtcctgggggggtctgggagagctggagaggggcaccctagcttcgtgaatggggtcctgggggggcctgggaaagctggagagggggcaccctagcttcctgtgtggggtcctgggggggtctgggagagctggagaggggcaccctagctccctgtgtggggtcctgggggggtctgggagagctggagagggggcaccctagcttcctgtgtggggtcctggggggtctgggagagctggagagggtgcaccctagcttcctgtgtggggtcctggggggtctgggagagctgaagagggggcaccctagctccctgtgtggagggctgggggaattctggagaggcgagctggagaggggtaccctagctccctgtgtggagggctgggggaatcctggagaggagagctggagagggggcaccctagcttcgtgtgtggggggctgggggaatcctggagaggagcaccctagcttcatgcatgaaccagcagcacaagtcccaggctcactacgagctgcacttgcacaggtgacccaaaacaacgcagcagaggctctggaggctgagctgacattggaagctttgcacaaagaggcaaggaagagcttgggcactggaattaaccgtgttggttgttgctaaaacaaacaaacaaaaaaacctgacacgctaaaggatttttaaaaatacccaaagtctcaaatatgtaaaatgtccaggttgcaataaagcgttatttggcgtaacaacaaccaggaaaatctgaataattctcaagcgagaagagaaccagtagggttagatttttccagtaacatgaaattagaccgacacacacacacacccacacacacacacacaaaatcaaagaaatgaaaaattatgttctggtaaatatgaactggaacaattagtgtaattgcactttttaaaatgtatatatttcctggctgttcactgaaggaatctagatgaaatgataccccttgagctctaagcttggtttctcaacataacctctcaacgaggctcaggctctttagaggaacagctaattccacgtctggaagttcaaggtgagcctggcctctcttagtggccaaaaagcaaggaagttttcaaagaccaacagggcatgtcaaaaggactcaggtgccagcttgaagggatctggccagcccaatttgggataatttgagtctcaagaagatattgaccaccaaagagtctactgtctggttccattaatatgaagttctagaaagtcacatgcacacagttacagaaatacagaaatcaggccagcagaaggttgcacagggggacaagagcaccctcccgggtgatggaaacgttctgcacctgggtgggggtgtgggtgacacaggcatagtcatgtgtccaaaaacccaatcaactgcacatttaaaaatctgcacttaactatatgtaaattacagtaagtcctcacttaacatcaatggattcctggaaactgtgatggttaagtgaagtaatgtatagcaggtcctcaaataacatcattttgttcaacattctttcttcctttaaaaaaaaaaaaaaaaaaattctggggccgggcgccatggttcaacctgtaatcccagcactttgggaggccgaggtggatggattacctgaggtcaggagttcgagaccagcctaaccaacacagagaaaccccatctctactaaaaaatacaaaattagccgggcgtggtggtgcgtgcctgtaatcccagctacttgggaggctgaggcaggagaatttcttgaacccgggaggcggaggttgcggtgagccgagatgcgccactggactccagccgggcaacaggagagaaactccatctcaaaacaaacaaacaaacaaataaaaataaataaatttaaaaaatactctgtagagaaggggttttgccacgttgcccaggctggtctcgaatgcctgagctcaagcaatccaccagcctcagcctcccaaattgctgggattacagatatgcagcactgcgcctggccaacacagtttcattatagtttctgagaagaaaaaaaatctgtttcattatacatcatcttacttagtcatttcacttaaaattgcagtttctaaggacctatcaacaacataaagtgagggcctaccgtgtaccttaacatacctaacgtgtgtgtgttgggcgggatttggctacggttgatgttaaaacattaaacactgaggcaggaggattgcttgagcccaagagtacaaggctgcagtgaggcaagatcatgccactgcactccagcctgggtgatggagtgagagaccttctcaaaaacagaaacaaaaaagttaaacaaaaatcctctaatccatagtaatactttaaaaagagaggaaaaatgaaaggaataaacccattttgccatgccctaccttgaaaattaaaaataatttaaagggaaaaagcatttatcttgcttaaaaaaaaaaaaagcgtattatccctctcgtatcttgctttttaaggaatagagttcatttctacctgatctgcacaaagctcttcgttataaaggaaacagctaatacacacagaggaacagaatctgaagatatcatcctggagccccatggaccccacgagacatggatgctgacaccatccagtcaaacgttgaggacagaatattcacacagcgccagaacctccctcgagatgagctgatagtcataaagggaaacatcccaaaagttagggcacttccacacggccacagcaccacagcaccacgcatcgaaaggaaggtgtagaaaccccacagtcccacctgttctctgtggtctcgatgcctctgcgtccgctttcctcttgttatccgcccacctcggtctcccaaagtgcggggattacaggtgtgaaccaccacacctggctctgcgtctactttctatatgcacattctactgaatcacctggctggaatcgagtttcaccttctccagaaaacctccttgtgtaggtacaaatatgcacacctcatctccccaactacgtgtcacttcttacgtgattcacagcatccagtcaagaaatgtgctgagccgacacattaacaacggggagttcgggtggagatgccatctaagagcctcagcgcactcatggccacatgaaaaccctcgcagtttctgcaggtggaagaagcccagcacaaagacccacctactgtagggttccatttacatcaaatgcccaaacaggcaaacccagagacaggaagtggatcagtggctactgagggctgggggaggatggtgacaggtaagggatgccaggtttctttttggagtgatgaaaatatccgaatgggggggtgaggggagggggaatatcaggataaacagctaatgcatgtggggcctaatgcccaggtgacggggtgatgggtgcagcaaaccaccatggcatgtgcttacttatgtaacaaacctgcactttctgcacatggatcccagaaatcaaagtaaaattaaaaaaaagaaaaaaaaagaaaatgtcactattgactggcaatagtcatgccactaaaagtcattgaattctgcactttaaatgggtgagttggatggcgtaactttacatcccaataaagctgttaacaaccaaagagcctacggagacagagttcacaatctctaaccaatgccacttggtttgtccccgcaacatggacctcgcgggcagacaagctcatcgtgacaaggacaccagcagctccattcccggcactcgctctgccccaggctcggtgctcagcgctcacacacgttgttttgaggaattcctagaacatccccataaggtactgaggagatggaggctggaggccaggctagatcatgggaaagccacctcaggctgcccagatgactgcagaggcagcaccagctcctccctaccttgcgatacgaagcaccctcctccgctttagcgactcgctggttcacgtagaacacacgggggatgctcagcctgatgcagtgcaagtcactgccaacgagcgcccacagcctgaacaggccggcctggctggtctcgctgatctgaaaggccacacggacatacagcacatcacaggacacactggaacccacagacggggccaccttccaggtagcttgcagctcccagcacagggccttaggcctccctacgatgggcaggaaactccaggcccactctaaccctcccatcccagacctcagggcccagctggacaccccctccctgggccatcagcagagccactgccctccccttggatcaaggtctatacctgcacaatctgccacggaaggtccaggatgctgcgggcagttcttcgcaagaagctccccagccccgtggcaggaccatcccggatggccccgggcctgagcacaccctctgccgactccagacgctgcctcttcctgcgggcgaggcgctgccgggcctgcagctgccacttcttcttgtggaaccggagccagacaagccattcctcctgggatggatggtgagcacagccagtgtgcaagtggtgagatgggaatgcccgccatgactttctcacaagcagcctccctaggggtcaggacgcatctcgggctccctgggctgtgcagacccctcagagacagacagtatcacagctgtgtgccttacctggctggttcccagggcgggaggctgccccaagatttcctgccagggcacagtcggcgtgaggtcctgggactcctcctggctctcccaaagaactcgcttcctcttcacagtgacaggggctgctgggtgaggcagctttacgaggccgaagtcctccatgtcaggagcacttggcctcggactgtcttctgaggcctcggccatcgtgacctggaaagacccagtgaagccttaaatctcaggatctcgggctgcgcagggtggctcatgcctggaatgccagcactttgggaggccaagacaggagaattgcttggggccaggagtttgagaccagcctgggtaacagcaagaccctgtctctacaaaatatattacaaattagccaggcgtggtagtgcgcctgtagtcccaagctacttggtaggctgaggcaggaggatcacttgaacccaggagttggaggctgcggcgaactatgatcacaccactgaactccagcctgggcaagtgagaccttgcctcataaaaacaagcaaacaaaaatctcaggatctcatccccacaaattctacttctcgaaatctagtataagtatatcacctgaaatgggatgttcgtttacacaagtttattgaacctttaatagtgaaggccgggtgtggtggctcacgcctgtcatcccagcactttgagaggctgaggtgggcggatcacttgagcccaggagtttgagactagcctggccaacatggtgaaactccgtctctacaaaaaatagaaaaattagctgggtgtggttgtgtgggcctgtggtcccagctacttgggaggctgaggtggaaggatcacttgagcctaggaggtaggggttgcagtgagccaaggttgcgccactgcattccagcctgggcgagagggtgagaccctctttcaaaaaaaaagtgaaaagatcaaaccgaaaaataaaacgtcactcaataccaccaataagtaaatctttgcattttgccatgtttgctccagaatgctttttgtaagaaagaaaatattgcaaataatgggtacagccctcttctgtctgcccccacacacctttaaatttttaccacatgtccacagacacatgccacagctgtaagttttaacctaaatagtaacatgtgggacacatctgactgcaacttgtttcctttttttttttttttttttttgagacagaatctcactctgttgtccaggctggagcgcaatggcacgatctcatctcactgcaacctcgcctcctgggttcaagcaattctgcctcagcctcccaagaagctaggattacaggcacctgccaccaagcccggctaattttttgttgtatttttagtaaagatggggtttcaccatgttggccaggctggtctcgaactcctgacctcaagtgatccacccacctcagccttccaaagtgttgagattacaggcgtgagccacatgcctgtccctgcaacttgtttctttattcagccatgtatttttgagactgacaccgggtgaaacatgcacatatggttcgttcattgtaactgatgtgaaatgatttatcatataaacacatcagcctacctacccatgactttgcaaatgaagaatgacaagcgcctactttttcaaaactacaaactgtgactcaatgaccatctctgtatgtgttgcctggtcccggagaacaaccacctccacctctagcaccagggatttcctacttcccacaatcttgctacttgatgccaccacacttacttgccttcagtgtgacctgctatctaaatacatcatgctgcatttacctcatcaacagtaaggctgaacatcttggccctgtgcaggcagctcccaaaatggcccaacgacccccacttcctggtgttcacaccctgtgtgactccttccctgagtgggggtgggacccggtgacttgcccgtaatgaacagattccagcaaaagtcatggaatgccactcctgagagcagctataaaacactgtggcttctgcctggctggcactctctcaaaagtccagtgccatgctgtgagctgtcctgtgaagagccccatggagcaggggactaaggataacgtccagacaaaggccaaggaggaaccgagtcctgccatccccatgggagggagctcggaagtggctccttctccagtggagccctcggatacacgagtgcatttaagttgctaagttttggggttacttgctatgcagcaatagatagctaacacgtttatgagccatttctaacttttatacattctaaacatcttcaaaatgtgactcaggcctttgtttcatggtgacttctgtgctacatgtaagtttgtgtgtgttgacttcctatcaggaaagttttcaaacatacacgaaagcacagtaatgagctcccatgttcttatcaccagtgtcaacaattatcaacattctgcctttcttgtcacagactacacaagatttaacttttaattaattgatcattctttccctttgtgatgtttttcacatgtgccttaaaaaagcccttcccaccccagcatcatagtctcctgagttgtttaccaaagattgtagtttcctttttttttttttttttttttttaaagacacaggggtctcgctctgtcacctaggctggagtgcagtggtcatcttggctcaccgcagcctcaacctcccaggctcaagtgatcctcccacctcagcctcccaagtagctgggactacaggcatgcacaaccatgcctaatgttgtgccggattttttttgtagagacgagacctccctatgttgcccaggctcgtctggaacttctgggctcaactgatcctccttccttggactcccaaagcactgcaattacaggcatgagccatcacactcagccttagtttcacactcagtgtgatacaacaacttacttctccaaatatgaaaaaccattttcaccagcatcactcactgcagtccactctctccttaacgatctgtgacctaccaacttccgactaacaggggagtctgtttctaggctcccaatcggctctactgctctcctctcatcttgtcaagatgccatgatagtgtgtctcgttacatagtaagatcaacgtgccctccttattcttcaaaattctttggttattcttatccttaccctttatatgaattttaggattcgtctgtcaagttctatccaaaaagcttttggcagattcttttttattggaattacactgaattttatgaattaatatggggcaaactgccatattttaatactgagtcctttcatctgtaaagatggtacctctttttgttacttaggtaaatttttatatgttcaataaagttgtgtataggccaggcatggtggctcacacctgtaatcccagtgctttggggggggcccaggcaggaggatcacttgagcccaagagtttaagatcagcctgggcaacagtgagacccagcctctacaaaaaatacatagccaggtgtggtggtgcacacttgcagtctcagctactcaggaggctgaggtgggaggataacgtgagattaagagttctaggctgtagggagccatgatcttgccaccgcactctagcctgggtgacaaaggaagaccatgtctcaaaaagaaaaaagttgtgtaattttttctgtaaaagtcttacacacattgttaccatgaatttattccttagtacattatttattgctattgtaaatggtatctttcaaaaaatattttgtttctagtataaatgaaagcaatagacttttatatcttaccttggtatctaattgttgctgaaatacatataagttaacacaaaatctaggtttccttacattttctgttaacaaattacatcgcctgtaaataataagttgatgtctcccttttcaatccttaattctttttctggtttaattatgctggctaggatctccaaactgttttgaacagaagcagtggttaacaggcatccatttcttactccttacttcaatgcttccagtgttttgtggttaagtatgaggtctgctgttaggtttcaagaacactttatcaggttaagaaacatctcatctattctgattttgattgttcaaactttaacatgagcagatgttaaagttttaccgcatgttgtttctgcatctattggagatgatcttacgagccttctcctttaatgatgaattagtggatttctcccaagaaaaactaacctggcaaattctaaaattaaacagtgcttgctattcccagcataagtcctagttggtcatattgttattgttcatgtatgttgatattttttcatctattgttcatggcccgtaactttcctttcctgttttcaattatgttaccaaagtaacaaggattgccaaggttaccaaatgagctaagggttttttttttcctttttctcttaaaaatcatttgggtttgatgtttcttttacacttattttttttcgtctcttttttttttctttttgtggagaacggggtctcgctatattgcccaggcaggtctcgaactcctgggctcaagctatcctcccgcctctgcctccctgagagctgggattacaggtgtgagccactgcgcctggcctgtttctttttaagtgtcaatttctgtaatggttaaagttctattcaggtttttattacttcttaggtcagtgcataacttgaggatactgtccgttccatctatgttttccaactgtttagcagaaaatgggaatccttccatttttttaggctttactatatctataatgatgtctgttttcattaaaataaaaaactctgtcctgaaaaagatgtgaccagccaggacaacatgacaaaaccttgtctctacaaaaaattacaaaaattagctggatgtggtggtgtgcgcctatagtcccagctatgcaggaggctgaggcaggtggatcaattgagcctgggaggtcaaggctgcagtgagccatgactgcgccactgtactccagcctgggtgacacaatgagaccctgtctcaaaagaaaagaaaaagatgtgactattttcctaagtcttttcaaagaacaacattttggttgtattgtttgtttcactcattctggctcaattttgtaacctctttcttttctttcttgagttgggttctccctgtgttgcccaggctggggtgaagtgcctattcacaggtgccatcatagcccactacaacctcaaattcctgggctcaagcaatcctcctgcctctcagccttccgagtagctaggactataggtgtgcaccaccatgcctggttacctttataactctttataacttctgtctacttcctctgatggatctgttgttctctaactttttcagttggaaacttaattttctatttgtttttctttactaatacatgcatttagatatataaatgcgtatacaagtcctgtttaactgcatactacaaattttaatagcatttgtatttacattcagttccaagtattgtctaagttctatgacttttttgatccacaagttataaatgtgttttttttttcttaaatttccaaacatggtctgtatttaagttatctagaattggttgcagcttactctgtggtatatatatggtcattattttatgtattcttgaaaaggataggtattctctaattttagtgcaagactacatttgttcactaaatgtattatagctagtgactaaatctagttagttgattgtgtcattccaaacatatttttgctgatttttggtctgctccaactatcaattgagggagggatgttaacatctcccaaactgattggaggtaaattcttcttataattaggtaaatgtttacattatttaatgtgaggctacattgttacaattagtatatatttccagagaattgtgactttcagtattatgtaacaatagtccttatgtttcctaatacttttggcctaaagagtattttgtctggtattaatacagccacatcagctttcttttggttaacatttacctggtatacgtattttttactccttttgcttttcctgcgtcctatcttttcaatataactcttgaaattgttatactggcccataagccactgggcgcagtgctgtatttccagcactttgcgaggccaaggcgggtgcattcacctgaggtcaggagtttgagaccagcctggccaacatggtgaaaccccgtctctactaaaaatttaaaaaaaaaattaaaaaaataaaaattagctaggcatggtggtgcgtgcctataatcccagctacactagaggctgaggcagaaaaaaattaaaaaaataaaaattagctaggcatggtggtgtgtgcctataatcccagctacactagaggctgaggcaggagaactgcttaaacccaggaggcagaagctgcagtgagccaaacccaggaggcagaagctgcattgtgccactgcactcctgcctgggcaatagagcaagactccgtcttggggggcaggggaaagaatacatatataactcttacaaataagacagttaaattttaaaatccaatccatctcagaacctttttctttttttttttttgagacggagtctcgctctgtcgcccaggggagtgcagtggcgtgatctcggctcactgcaagctccgcctcccgggttcacgctgttctcctgcctcagcctcccgagtagctaggactacaggcgcccaccactacgcctggctaattttttgtatttttagtagagatggggtttcactgtgttagccaggattgtctccatctcctgaccttgtggtctgcccacctaggcctcccaaagtgctgggattacaggtgtgagccaccgcacctggtcaaagaaccttgttcttgtcatgtgagtttgtatactgctctgatttatagcttacttttaattttcagcatttaagaattttccttttgctcttctgactttcactgtaccttttattacactgtgtcctgtgtttctaagtgtttccatagggaagatattcatttcacattcagaaaactggggcttcaagagacagtgatttgcccaaggcactgagtctaagtagtgcaccctaatattttcacataaggagacagttccttgccctcacctcagcctcacaatggtgtcctattaacaaaagagtgacactcagagttagagagtaaagtgccaatgggcacattttcagaaaaagtccattttcgatgcttgaacagaagcttcactacagcacacacagcagcgcaagaagcctggagtcctgtgtgtcacaaggatcccgcccagcccagccttggggccccaccgtcacctgtctcctgccctccagggtgaagagctcactgatcttcttctgcttgtagacatcattcttctccagcagttttttgtgcagccagtcggggtgtttgacacgtggcactgggttctttacctgtgtgaggccaacacccatcagagagagacccttgtctaactgcacagtttttagccccacagcccgtgccactgaccccgcccttacctgctgcagggccgcagggatggtgatgatcttctggatggcgcttcccagccgctcaatgtagtagtcccaatccagaatctgcatgtgcaggaaacgggcacagagaacagcaggtggcagcagccaagagtggggctcacttcatgctgagcacagggctaaccactgtgtcttatttaatcctctcagaaactctatgatgaaaggtgcccattgcacaacagaggacaccaaggcagggagcttcactgactcctctagatcacagagctagtaggtggctgagccaacacccctggccttagtccatccaatagaacagctaaagggccccaggcacttcatgttttcagttttgccctaaaaggttattaggtgctcacctattacttatcagaaaggaggaagtcaagagtgaagacgccagacaaaaaacataatccaactcagacatattctgctctgtctagctttccttgtaaacttttaagagtagagaacgcaactggcactcactgctcgaatatcaaagtcttgaagggaagagctcttgagccatttccggagaaagtgcttcctcaccgtgggctctgcttggaaaatggcaagtgggatggccctgggtaaggaagacaggcacacagctcagtaacagtgaaaatcacccaaaatctgatcctaactcttatcaaatgaacatggaaataaggacgtgtaacagctgttcacaaacatcaatgtatacatctgcgtgcatatgtatgcacaaacatgcctacaggttcctcggggagtaacacgtgcgtatgtgtaaacacgtgcgtgtgtgcacgtaaacatgtctacatgttcctcacagcgtaaccatgggcatgcatatacataaacacatgcgtgtgcgtagacatgtctgcgtttctcattgagtaaccacgtgcatgcgtacaggcaaacacgtgcatgttcgtaactatgtctacatgtttctcacggcataaccatgtgcatgcacatacataaacgcatgcgtgcgtaaacatgtctacgtttctgagtaaccacgcgcatgcgtataggcaaagacatgcgtgtgtgcgtaaacatgtctgcgtttctgagtaaccacgtgcatgcatacaggcaaacgtgcacgttcataaccatgtctacatgttccttgctgagtaacacacagaagactcaggctgctttctagaaaaaacgagcctgttttcatgtcactagcaaagcaactggcaaccgtcagtgcttccctttcactggaggaaacatctgtggtgaatactgcaaacataaggagacctaaagaagacacgcacactatgatccactcggctccatcaagcttcaacacttggccactctgacttcctttgtgagacgattagagtgaagccctgtgtgaccccaacctattccctcctcacacagaagtaaagacaacccttattctggtgttcatcaaccccatgcaggcatttgtactggtcctatttgtatataaccaccaaaaaaaaaaaaaaaaaaaaaaaaaaagagcagtttccatgtttttaagttttacatacacggaggcataagggtcttccttcaacctgatttttgcttttttctccaaagtggtttcaaactgtcagtgttgtaacctgtagctgcaattcaaccctttgaactctggtatagtgtatctcattccctacaaaatggcaattatccatttctggttgatggacacttatgccatccccaaacttggtgttaaacacagcccaaatctgtaaggaaccccttacctctccgtgacagggcagccctcacctctctgtgatgaggggagccctcacctctccgtgacggagggagccctcacctgtccgtgatgggaggagccctcacctctccgtgatggggggagccctcacctctccgtgacaggggagccctcgggcttgcgggagatgatgtagcggcaactcagccctgcatccttgaccatctggtctcccaggaactcggccaggcgctttgctgtgctgatggacgtagacttctgctccccgtaatcttccagcttccgagacatggaacggttctcagagatgagctcgaatagctcagagtcaggcatgttggctgcctagagaaagacaatgggtaaaacactgcagaaatcaaggggcagagtctgagctcaccctggactgtgctcctctaggccatgcccttctctagcctgagacgcagaaggctgcaatttcaagagctctctaatatgcctgtgtggcaatactttaaaacatacacacacacacaaaactttagcttttatattttttttgagacagagtctcattctgtcacccaggctggagtgcagtggtgcaatctcaactcactaaaacctcccctcctgggttcaagagattctcgtgcctcagcctcccaagtagctgagattacaggcacatgccatcacatccagctaatttttgtatttttagtagagaaagggttttgccatgttggccaggctggtttccaactcctgacctcaagtggtctgcccgccgaggcctcccaagtgctgggattacaggcgtgagccaccacgcctggcttggcttttattttattaaactgtgcacaaaatatcaagaagaatttactgaagagcaccaaggctgcagaaaaggatgttgctcggcctaagacaggaagtttttctccttgaaaggaagagaaagaaggggcaggaagagccagaagagaggaaagagaaactccggccggctggagagtggcctgagcagtggaggcctgagcagttccagtgtggcacccacatccagctggagctgtgctttgcacacatgttcctgaccacaggccccccacatcctgtaaggagtgctgggctcatgaatattctgtgtgataccctggtgctcccttgctcgtgtgtttcactctatacaagacaatatgccaagaaacagaagcccacacagcaaagcaagccaggaaagcactgcagagtgttccagtattccttctacccaagacgcctgtgcctgggaaacatatgcaccgagatatctcgttcaatgcaacaccattgataacaatggaaatgtgaaacctatctggtagtaaataatcgtgggctagttacgtaaattaaggtatgtaaactgtcaaaatgttatgtagcctgaaaaatataaaaaatacaaagtaacatagaaataaacaaatatcccaggctggagtgcagtggtgcagtcacggctcactgtggcctctacttcctggtctcaagtgatcctcccaagtagctgggaccacaggcacgcatcaccatgccaggcttatcacgctatttagaaaaacgtttccctcagagttgtgtccctggatgcagaagttgaggggaactccaagggggtaattgtgctcaggaggtcttgggatttcattaggactggccctgtgttcttcggtcaccttggtctccaggagcccaggaagcacggggtccccttcttgcttcatccttcatccctcagagcaggtgagggtggagggtaggcctttaccttgctgtacagcacgtccagccagtagtcagccaccttggctacagagccatacacctcttccagcgtgctgcccttgaggaaggcctcaaacaccgaggattggaagatcttaatcagctgcagttccccgcggcgtttgacctcaaagcccttgagctcagccagagaaccgtcttcattgaacacagcatacctgaaaaaaaaaaaaaaggcaagcacagcagtggcaaggagcgctggggagccaccagctgtgcctcatcctctctgcccgcctcttccctttccaaccctccacctgtcatccacgaggcagcaaacgtctctctcccttaggccactgcttctctaaaaggaaaatggctgaagggcctgcagccacagagccagaatacagcaggcgggcagacagagctggtgcaaacggaatcagtaagatcacaagaacccaggtctgtttctatcctggctcctgatccaacctcctttctgggctaaatttaatctatctcaatccatgtcctttctaaagcacaaaagctatgagagtcccacctcttcttcaatttcttgccttcttccttggaggctggaagaatcatggcaaggtagggcccatcaacctcaaaaaagatgctgttctctgagcgggtgacgtaggtgagtgaggacggctcagccagctcctggtactggtcattggtgaagccttcctgagaaacaagagtgaagagggggcagcttcactcatgatggcccaaacctggaaaccacctggtgtccctccaggagtggatggattgacaaaccgaggcttttccacataactaacacgacttggcagcaggaaggaaggaagttctgatgcatgcaaccaagtggtgaaactcaggtgtatctgttaggtccaagaagccagacccaaaatgctacaggccgtatgcttccctttacatgacattttcgacaaagcaaaattatagtacaaaaaacacattgtgggttgccagggtttcggggtagggagaggatttgctgacaaaggggttgcagctgttttgtgttgcttcgtggtgctggacacacacactatgcacttgtccaaacccacagggctgtacgctacagagtgaacgtcactgtgtgcaaattacaagccatccagccatggtgctgggatcccaagaggggtgcagactgggccaaatgagcccaacagcactgtggacatacagcagaacatgccaacagggtggggaggaaggagctgcccgtgaactctgctgactggacagggtaaggctgaaaacaaaagtaactatctacaaatgctgtacagtggctggtgaaattatttctcatgggacacaagtctgttagcaattctaaaactactttacatggactctaggattgaacaaacacatatattgagaaattcgaaacaggtttatcactgaaggagaaagaagtcactaataagaaaggggcagactcatgtgtttaaatgcatccatgcagacagacagacacagaaataaacagttctgtgtgcgtgcgttactagagacatacttcctggctgcctccactatgagagactggaagctatgacactcccaggaacagtgagcacagcaagcaccccatctcgggtttttacatcattcttctcggagaactggctgactccaggttggagcagggaaaatacaagatgaggctggtggaccttacagtaccaagaagtaggaaagtgctccagaaacaaagaccagaagagggcgtgtcccaagaacacgccacaaactaggaggccccagtggcccaaggggaacacgtggagcaggaagccactccggtcctatgaacaataaccctgggatgtccactctgatccgcaaatccacactgatgtcaataagcagacaaataaacgagaacaaatggaagagaaggatagcaacgcttccctacaggatcccaattgatacagtagaaggaatgaaggaaacagacaatcgccagagaaaaaccacgacaggaaacctcaggcgtaactgctgcaggtgcggcccaccagcaaacacagcccatcagcaacgctaacacagtgggcagaagcttatggagcagctgtggatacactgtctcgaagcacctgctccacgatatctatttgctgctgtgatggctctaatacaggtccagaaactctgacagccctcctccagggacgcttatatcctccccactgggtgtgtatttacgactgaagagccgtatgggagggggcacaggagcgccacagtaaggcctgcagaagcccctcaggcaggagactaagccgtccccacaacacacccacactcccacaccaccacaaaccaacacgatgcgtgtgagaacgtggggagggtgtcgcacctgtggagctcctccaaaaacccaaatcacctcagtctagtcacgagaaacaacagacaacccctgatcaagggacagccaaccatcgcctggccggcaccaccagagggggaggtcgtgacacgaggacagaccgggacaggacaactcggcgccacgtgggtccttgctgggatcctgggagagaagaggggctatggtgggaaatgggaaatccaggtgaggcctgcagtgcagttactggggcacagacataggtttcttagttttgacaagcgcaccatggtttatgcgaggtcagcattaggggaaggcaggttgaaggggatacagaaattctctgtactatttttgtaatttcctgtaagtttaaaattatttcaaaataaaaagttaaaagcaaaaaattctgggagctatgctgaaagagaaaggagtggaatcacttgatacctctgaccatggtcttcaggctatagaaaagcaatgtgagcagtgctgggtgccaggaaggcatgcacactgtgaggtgctgcagagccagtgacatcagggcactgacgccaggccagccagagcttcaggaccagaggccccagactcaccttgaccatgatgttcaacatggcgcctgggtaggagatggtcactttgggcttcttcacattggtcgtcttgaagacaaaattttctgggaagctgttgggcaggacgcaccatataccatctgtgtccagctctaagggcctccttcagagaaagagaggagcaaggtcgtgagttcccctttccttttcacccagtgtgtggcctccagccttccctccttccttcctgcccagtgtgtggcctccagccttccctccttccttcctgcccagtgtgtggcctccagccttccctccttccttcctgcccatgcttgcccccaggacctgctcccagccccacggctccccttctgcactcacccaatctgctcgatcagctcccgtgcctgggtgatgatgttggcccctgtgaagcagacgatgccagccatctccatggagtaccagcgagccctgagaggacaccacaaactggtgggtggggctggcatggctcctccagggggtatcagaggcagtgaggagtagggaggaggaaaggagagatgcgacagggacaagggaagcagccaaatgtgcgtgcaccaggacagaactaaggtggaatctggctctgcccgaggacacctctctgtccccaccttggtgcccaggaaggatctggaagggtgcagtatgtgccactgcgtccagccgttcaggactccagcctcagcaggactcttaataccacccagacccattcacgccttctctactctcttcacacctcctcccaagccccattctcacctccagcttctcagagaaagcccaggcctagctgccaggcccaaccctcctccagcctgggtcccagccctgctgtcagctgtcccaccctcccctcccggcaccagccccatgccccttgtcagttgcttctctgcccctcccggacacgcagacatgctgtgaagcaactgcccgacactctgcaagtccctgagtgaggatccacgctgggagacatgaacgcgctggaaaatggcaagtcgtgtctccagcccatgatgcagagacacatacaccccacagcacgcatcactcatggacacccagaccctcaaagtcagcgtggcccccactctcttcaacctcccagccccaccccagcccaaagccttctccctccaacattccttgaatcagatgaacggccctccatgcacagcagcctacacctgaagctgccctaaacgtggactcatccattcctcccataagcctctcccgggcccgggcccacctaccccttgcgcatgacatagccatagaaggagttcaggatgcacttgtgggccagctgcagcgagtcatacagcacctccatgttcttgcagcgcttcacctcagccgcgtcgcccacctccacggccgccgagagcttctttttccacacctgagaagcacatgaacatggagcacctcacagattcttccatttcacattctacaaagtcaatagcccaggtttttagtattttgaaaattttcaaatctatagaaaacctaaaaaaccagtacaatgaagagtgtacattcttctcctagactggccaactgtcaatattttgtcacacttcctttattctgtctctctgtgttgacagaatcatttgaacattgtagatttcacggtctgacatcctaaacgcttcagcacagtttctagggaacaagagctactcgggggtgcctggtaaaatcaatcaagaaatgcagctaagaccacagatgtctcatcaaattccccacccaacatgagaaaaggtttttaaaggctgggtatttaaggaacaaaagcaaattccttaagataattactgagtgcctagtatgtgccaggaactccattgtactctgaagcacgagacagtcactacacttttggtgcttatttgatgagggagacagatgaacaagtaatttagcagttgcttaattaaaataaagtgagatagtaaggcagctccttaaaaggtaaatgtagaattagcatatgacccaacaactctactgctgggtacatatccaaaatcaccaaaagcagagacctgaagacgcacttgcagcccatgttgaaaccaggattgctcgcgacagccaaaaggtggaagcaacccaagtgcacgtcggtgtatgaaggatagacaaaatgtgacaaatccacacaatgaaatattattcagccatttacaaaaatacagtacagatacacgctgtatgttgataaaccttgaaaacatcatactaagactgggcgcggtggctcacgcctgtaatcccagccctgtgggaggctggggtggatagatgacctgagttcaggactttgagaccagcctgggcaacatggtgaaaccccgtctctaccaaacatacaacgatcaggcgtgatggtacgcctgtggtcccaggaactggggaggctgaggcgggaggatcacttgagcctgggaggtggaggctgcagtgagccaaggtcacaccactgtgctccaaccttggtgacagagtgagaccccgtctccaaaaaagaaagcatcatgctaagtgaaaaagccggtcacaaagatacaaatactgcacggttcacttacatgacatccctagagtcgtggaattcagagagagaaagtggaatggggtcactaggggccagggaggaggtggggagctactgtttgatggagataagagtttccgtttcagaaggcgaagaattctggaggtagatggtggtgatagttgcacaacagtgcgaatatgcttcatgcccctgaactgagcacttaaaaacactaaatgtcatattatgtccgccttaccattataaaaaagaacatgtgacgatgagttcagcagggcagtgcaggatgccagggggccgcacagcaggggccgtgctgagtctacagtgaaggtctctcagaaaaaaaatggctcaatctgatcagatataaaataatgacccgttggtatcaaaacagaggtgttgctatgcattttccatgttcctaccggatgaaatacgtcagttaaacacgaggggccggatggtgaataccatagatgagaaggccttagagtttctaggaactcctcacctcccatgacagcgggaaagagataaacaataggcgaaggcagttgggttcgtaaaacttgatgtactcaaacggccagccagctgtagcttgctgacccctgctctaaataatcactttagaaatcatcctttagggtccttctgaggcctcagaccagggtggatgatggtctgcatccttcgtggccatcaactcttccaagtcaaaaacaattgcacgttaccatccgagtgcaagtgcctgctcagaggatcccaggcaaggagccaagagtgcccacttcatgagccgactgaaactgccctcacagaggccaaagcttgcagcccctcagagctcaccttgtggagccctttgaactcgtaacgcctgtcccggaaggcacgcacggtgtccacgtagaaggagttttcccgctggcagatggtggtgagacgctcttccaccttggtgatgtggatcttcttgtaggctttccggcagtaatctaagcacgacggagatgggcagagcaggtgggtgagatctcccagagcagagggagccagggcacaggggtgctgaagaacatggcttctacgtcaccacaaaggagcaacagctcagatacactgctagtttctcataccgaaaaaggtgggcgggcacggtggctcacacctgtaatcccagcactttgggaggccgaggcaggcggatcacttgagcccaggagtttgagaccagcctaggcaacatggcaagaccccatctctacaaaaaatacaaaaaattagctaggcatggtggcgcacacctgtagtcccagctacttaggaggctgagatgggaggattgccggtgcctgggaggttgaggctgcagtgagccaagatcacaccactgcattccagcctgggtgacagagtgagacctcatttcaaaaaaaaaaagaaagaaataggacagcccaggggtaggaacaggccaaataccccaagaccacagagcagcagtgtctaacacttgcagatggggaagcaaataaaggaccctgcagtgagagcacagcttacagtgacctagagcagcttctggtctgctgtgacaacacctctggggccccagctgggatggaccaacgcagcccagtaagaacagaaagtgggagcaggagccacatctttacagccgtgaccatgcccaggcactcacccgccagccttctcttctcgtatttcgcctgttcctcgcgggacagttcatgaaaggcccgagctggcccctctgggaacaagggggggaacttctctgactccagctggtgctggatccgatggtattcgctgcgactggctggcactgggaaggaggcaatgggggcaagttcaaaaggaggcacagacacaccggcttcccaccaagtggagaaaggcggccgacactcacccacccgtttcccaccgagtgcccacccaggcggccgacactcactgaactcgcccctccactgccaggccatcttccgctggcagtttgctccaggcttattgaagtcacaggcagcacaggtggcttcgtccaccatggcagagggctgggaggggtgagaaagcacttagggctgggcagagagagctccgactctgacacgggaagtaaagtctcacctgcaggcggttggtcaggatgatgttggggtacatggcccccacgtccaggtggtagatgagtggacactcgatgcggctgggaacgtccttcagggaggcaagcttgctcttaatctcatcacacacctgcagagaaagcgaaactcagtagaggctggtgaccaagcttgcctcgtgtgcagttcaccaaccccttttagacattcaggagaggaaaaagctgaaaaatatataaatagagcaaaaactagccagaagaaaaaagttaagaagggttgccatcatttctatgaaatacattaaatttggtggagtcattagaaaattacttgaacactaaactctccttagtattaaaaaaaatccttaggccaggtgcagtggttcatgcttgtaatcctagcactttcggagaccgaggccagaggatcacttgagcccaggagttcgagaccagcctgagcaacacagtgggacccccgtctctataaaaaataaaaaattagccgtgtgtggcggtggcacctgtagtcccagctactcggaacgctggggtggaagaatcgcttgagcccgtgaggtcaaggctgtagtgagcccagattgcaccactgcactccagcctgggcaacagagccagatcctgtttcagaaaaaaaaaaagaaaaagaaaaatccttaaaaccctccaaagtagtaaaaatagaaaacacacctaaaattttaagaaaaaagtgattacaaggaataacatctattccatagaacaggaaataccacaacagtaacacctattgtttctacttgaattacagataaacgaatcagccggggaagagcctccactgcacccttctctgcccagtaacggcgtgttctgaaaggctgtccagtcaagaaggggaggatgggctgggacaagtgaatggccaagtttccatggtggggacaccacctggacatgccccacgtggctgtgagcccctgctgacatccccccagccaccctccgcccaacaggtgacccttcagggacacaaaggcgatcctgggcttccctttcaagggcacttgcgaggacttaggaatcgctaacaggacaatgtcatctacagagctcccttcctcactcaccagggagcctggcgtcctcacatctacagagctctcttcctcactcaccagggagcctggcatcctcacatctaccacacctccagcctcactctacctgcccatctcactgtttcttaaagactttaaatatctgcttctaggtcgggcgcggtggctcacgcctgtaatcccagcactttgggaggccaagcgggcagatcagctgaggtcgggagttcgagaccagcctggccaacatggagaaaccctgtctctactaaaaatacaaaaaaaaaattacccaggcgtggtggcaagcgcctgttatcccagctactcaggaggctgaggcaggagaatctcttgaacccaggaggcagaggttgtggtgagccgagatcatgccattgcactccagcctgggcaacaagagtgaaactctgtctcagattctgagacgtctcgccaccacgcctgggtaatttttttttgtatttttagtagagacggggtttctccatgttggccaggctggtctcaaactcctgacctcaggtgatccacccgcctcagcctcccaaaatgctgggattccaggctgcccaggctggagtgtagtggagcgatctcggctcactgcaagctccgcctcccgggttcttgctattctcctgcctcagcctcccgagtagctgggactacaggtgcccgccaccacgcccggctaatttttttatatttttttagtagagacggggtttcaccgtgttagccaggatggtctcaatctcctgacctcgtgatccacctcggcctcccaaagtgctggaattacaggcgtgagccaccgtgcccggccatggccgacattctttaactcctatttgttattcagacaaggctctcttcctgatcggttcataagagttccctgaagtataataatggatgtggctgacaatagccaaacagtgcttcacagcttgccaagagtgtacacatattcttgtttaaattttgactagtgaatctattacaagatgtttcttgagggcaggcacagtggctcacacctgtaatcccagcactttgggaggctgaggtgggcagatcacttacagtcaggagttcgaaagcagcctggccaacgtggtgaaacctcatctctactaaaaatacaaaaattggccaggcatggtggtgggcacctgtaatcccagctactcaggaggctgagacaggagaatcgcttgaacccaggaggcaaaggttgcagtaagccgagatcatgccattgcactccagtgtgggtgacagagcaagactccgtctcaaaaaaaaaaaaaaaaaaaaaaaaagtttcttggcatcaatgtgaaaactgttaaaaactctaaaccagcaacctcactgaacatgatgtagtgctgcacagtgcctgacataaagacctgagataggccaggcgcggtgcctcacacctgtaatcccagcactttgggaggccaaggcaggcggatcacaaggtcaggagttcaagatcagactggacaacatggtgaaaccctgtctctactaaaaatacaaaaactagccaggtgtggtggcggatgcctgtaatcccagctactggggagcctgaggcaggagaattgcttgaacccgggaggcagaggttgcagtgagccaaactcatgccattgcactccagcccaggccaacaacagcgagactccatctcaaaaagggaaaaaaaaaaaaaaaaaaaaaaaagacctgagatgtgccatgtcctgaggaacagggatcagagaagaactggtgtctccctctccagtcacataacacactttgtaagtgtgctttctaaccattatgtaaacagattttacagtcactaatcctgtcatttgtaggaatttactgtcatttttaagtctcaacaacaaaaagtaaataaaatttaaaacctccaatggctccccagtgcctataaaataaagtcctaatgctttaaaacaggacacgggatacatcccaccaggacccaccttccatgttactgcatttcaggagcagctcacaccccacctctcatgaagccctccgaccttgtgacagcatcacacgtcacaaccatgactgccctgtcccaccagagaccctgtgtcatccgtccacagcaccacacgcagcaggtgcacaataaacgtgctgctgaaagacgtggtctgtgaagaaggcgccaaacacagactggctcttcctgcctccctgatggttacctcttcaaagttggtgacttgctccacaggcactttctcctcttcctcaagggcgtggcgcaaggtcttctcaacccgctgcagcaggaagtcaaaggcggcaggattctagcacaacagtgagacgacggggtcagaggggaaacacacccacactagcctgcctcaggtttgacgctgtggctgcacgtggcaggttgtgcccgagaaagctccggaaggactcatgtgcacaatctgcagtgcactgccctaaagaagcccccggggggtgctgggccagagaagccacacccggtgaggggccgtgggacaggatggggagaaggggctttatttcagcccctgcagcttctgggtcctaccacagcacaagagtgggaagaatctgaatcccagggaagaagcacaccatcctaaaccggcaagggatatcgctgcggaaaaccccagactcgagggcctccacgtggcccccgacgtaggtctcagagtccagcacgtgtccgtcgtccgtcagcttattgaactcctgctcttgcttgttggggaagatgatgttggcgtggaaggcctgcaccatcagcaaggcctcacacagagtgccagagcccttccgcagcacctgcaagagaaaccaaggcttccagccaaaagcaacaccaaaggccctgacttgcaggcaaagtccaggaacctaagctgaacttcagtgtgaaaggagagaaaacctcgtggtaaatggctgcaaattctgcctcctgtggtttcttcctcacaccagggccagagaattcccaaaggacatccctgacgtcacacaccagaattctactgccgcctctggtgccagcactcctgggacatccacctccattcagctccagtgcatttggaatggggcaagggctgaggaggccagggtgccgacaggacagataatgctcacctcgtcgggctccatgggaataatggtgcacagagcaaagatgaatgggtggacgtacttcatgtacaggtagtaagtggcgacagcatctgacacagaatacgtggccagagtctgaggagagaacgccagagagcagggccatcaaaaatcaagagcccagggtcaagtgtgaagcacagaaagcaaagcctggcctgaccagcctgccgcacacacagtaaggagaccggcacaggacaaaacacgtgtgtcccggagacacagcctgctgggtggagcgggctggcatacatgcgtgcacacggcagcagggggagccgggatgtggctcacatgcctggggctgctccgtggccatctggatgcgtgcacacggcagcaggggcagccgggatgtggcttacgtgcctggggctgctccgtggccatccggcacatgtcctccgggtctagctccacgggatcatagcctagcttggccttggcggccgccttgagattatgactgcccacaggaaggtaactgtccctcttcacccacctggaaggagaatgagaacagaagccaggatgattctaacatgcagcccgggaacccctgagaactggcaaaactgggcaccacacagacagatgcaagttcctaacaggcacccaggagcctcacaccaaggccccacatggtgtagacaccttgtgaaaacccttcatcaggatctagttaatctcacagacctatccacaacacaaggaagcaccaggactggtccttccggccctcgccttcctcccatcctcagcagagtttgtggcctctccgacgggcgccccacctccttgggcctctccccagacctcaggtctgcacccctggggcctagttctatcaaccacactgatcttctctcctcacactgtcccttcagcacggaaacactcaagcccaccctcctttaatagaaggcaagatgtgatcagatgccaagaagaataaaaatttaaaaaataaataaaaaataaaaattaagaaaagaaggccccccacactctacccggaacctgtctctacctcctccctacagacgcattccctggagcagctgtccaggggtcatgtccggtctccaccccccgcagcctccaccctgtggccttcttctctcactttacctcttgccttcagttcatccactaccccagctttcaccaagacccacccgcaacccagtgagtcccaatctacagtgcgagcccaaaccaagcctcatggtggtcttcagggcccccatatgggtggggcttccaggctagcatatcggtagcagggtcacctcctgcctcaagccccttctctacccattccctgtctccacggatggcacaaaaaccccaggtgccaacccctccctaagaaccagcatccctgggcctccccctgccccacatgacagatcctgaatcctcacaaccctcactccctgccttggatcaggactgtcacaccgtcacacgctaaaccggccccagcctcctggcctccctctccaagccaagtgctgagcatcagagctaaacagaaacgcattcaggctgcaagcaccccagtggcactgtgcagaatacagaggccgtggaggcccctccattcccttccttccctccctcccttcccttccttccctccctcccttcccttccttcccttccctcctttcctccctcccttcccttccttcccttccagcctccttctgttggcatttccacatccacctgtcttcccaaccagtcatgtcagagcccccgaacgccgtgactctccgaagctctgagctgcctcccaccctagctcatatggaatctgtggttgtcccgtgaggcttgtcctgtgaggcagccgggctgccacatcccaaccttgcctgggcagagcagctccatgaggtcctaggtctgggacctgtcagctgagtgcgtctttccagcggcttccccaccccagaggctgatgctcaatgtgcctggtcactgatgaattgtcagtcaacagtcaaagacagcacatcccgggccctggcagggttgcagctgccatactcttgggtgacctgaaacggcctctcggaggccaccctcctcccatgagatgtggtgacagcacagtctgcaagaggccttcagatctcgctcacggacagcagtgaggagccatgctgctctgtggcccctacctgaggcagtccatgtggatgcactggggcgccttgtactccccctggctgtccttctggaagcctatctcctgctgcatgctcagaccgtggactgctgcccgggcctccacaaatggcctgggttggaaagaggacagacaagcaagtgggcaggtcaggctctaatgcccctttctccattcctccctcagacccagggaggaacccagacacgggaggtgcagagtgaacccaggagccacctcctaagtcgacatgggaagcgcccctgcaccacgcaacgccctccctctcaaatgctgcccagttactcatagagaagacacagactcaccagtcaaaaaagtccccgttgtaggtgaccatgatggtgggtttggtctcctggacgtgttcaaaccacctttggatcagatgagcctgaacccaagtcacagcagtcagaggtctgctctttctcttcttcaagctattccaaattcctctcccaaagttcagaagcagcagcctcatgttggcccttattcctgccccgcccctccgcccgtctctggcagaaaagacggtcataccctgagaacaaagctcatggagctgcaattctgatctgacggaatgcctgaggccttggaaagatccacatgtccgttcttcccacaataccgggtagtttcccaagtgatacctccttacctcatcgggttcattgaagacacaaaaggggccttcatattctggcttgggggtgaactcaaaatcttcaatatcttctgaaacaatctccctgttggtgatgaggtagccctagccaagttcattagcaatcagcacaagtcagaggctgcaaagccaagaaatggcgttcccaccctgcccacacactctgcctagagattctcactacaaagaagtccacagcaatgtgaaagtgctttaagcttcctgagaagagacgctctgtgtgtggattcccactcgaaaggggagggtacagctggaggtcggaacggcttggttgctcccattcctggactaactcattattcactcaacaaatactaacagtggggcagatgctgctgtagtatggggaccagacaaggtccccatcccaggagcttacttcccagaagccacctgctcacctggccatcgatcatgtaggaaatcatcataatctggtctgtctcagcatcaggaaacttgaggggcagtttggtcgtctcaatgtcaaatgccaaaaccacagggtcctgtggggacaaaataagcataaagccaagctctaaactccccattaggcctccctgaacacccacccccagcctgctctacctccctctggttgttaaaagagtcaaaaggctctagagctgggagaaggaccctaagactaaccaacctacatcaagagtatcacgactccctatggtatgaaaactgacatacctaagagagcagctgatcacaggacaagcctaaaatcacagaactttaggagaaaaactcttcaaaagacatcacctcattctggtggttatgacaactctgaaaggtaactgtggcacagagatgatatcttcatttcggaaaagagaaaactgaatacaaagactttcccaacaccacaaagtcatgtttgaaccaaggccttctagttacaaatccatttttcaccatgtcccttcactatcaactacccaaacggaagtcccagctttccctcgagtgtccaaatcctgcctagctcaaacactgatgtcatacagtgatatacaacaaaaaaggaaatgatactgtcagaaactgatgaaaaattctaactccatatttcctttaataaagtatttgggggaaaagcagcaaacatatctttgagtcagattcactctccagcactgaagaatattctctccagaaaactggaaattttaggatgaaggtaacacaagcaaaacttacaggtcgttcaacaaggtcatctcggcgggtgatttctaccggaaaagcatttcctcggtatctgacattgtaccaatgagcctgcaaaacacacagtgtgctaactagagttctacatccaggaaagtctattcttctgtggattcacccataatgatcatctcctggctgttaggaaattcatgtgagcagcgacccaaccctgccccactcaccacgtggatcttcaggtcaatggagaggcggatgtggtagggaacatcgtactcgcgcatgtccacaatgttgtccaactggtcagctatcttcttagaggtttcctcttcatcagtaatgacaccgcccctctgcagaacactaggaattaacaagagagcaactaactcagctgccagggtctggaggaggtgagaccagagttccaactcagtaggaagaggtgagaccagagttcaaaccgaggaaacacaaaaggtaaattgatgtggtttcaacgaccaaggcagtccttcctttaagaatggcttggactgggccaggcgtggcagctcacgcctgtaatcccagcactttgggaggccaaggaaggcggatcacccgaggtcaggagttcgagacgagcctggccaacacgacgaaacctcatctctactaaaaatacaaaaattagccaggcgtggtggcgcatgtctgtaaccccagatacctgggaggctgaggcaggagaatcacttgaacccaggaggcggaggttgcagtgaacccagattgcgccactgcactccagcctgggcaacagagcgagactccatctcaaaaaaataaagaatagcttggatgataactctacagacaggagaaaattcagtgtaagatgtattcattttatatgatgtgagttacaccccaactagaaaaaaaaaaagagggccaagcatggtggcttatgcctctaatcccagcactctgggaggcaggaggatcgcttcggcccaggagttcaagacaggcctgggcaacatagggagactcatctctacaaaagtaataataataataataataattagccaggcatggggtacacacctgtgatcccagttactcaggaggctgaggtgaaaggatcgcttgagcccaggagttcgaggccacagtgagctatgattgcaccactgcactccagcctgggcaacagagcaagaccctgtctcaaaacaaataagtaaatagaagaaaaaagaaagaaaacattaagtgctgccagtcaggagagccaggcatgaccatcccaccatggtcctgatactcaggaggctgcctcatgcaggctgaagagcaggcctgggcttcacacagcctgtgcatgggtctctgccatgtctaaagaagtggcccaccattgcggccactattggcctataagctcaaatactgaacgggctattcagggggaaaaagacagacgagtctcagatatggctcaagtctctgaggactcagtctctgatcacaccttccaatatttcaaaaagcaacttgtggcattgccagggaaggcggactccgggtagggactgtagaaatgttcagcatcccaaactgatcctcttttgtcagagggtaaggtaggttcttccgaagtcatctaaacttcattactcaagattttctcttcctaactggttactttgcatcctattattgttgatgctcaaatacttgaagaacagtgtttagtgttctaggcttaaatttctgtggacgatacccaaggttctctggagatgtgctgtgtaaatctcagcacttaatgaaattcatagatggattgtgttagggcagtaggatgagggatcttttcccctctaaggtgactttactattacaaccactcaattttagagccataaacccacccctccattggaaaagagagctaacacataaaatataacctgggaagccactgtttatttaacacagaacatacagaaatctctacctaattgctcaagttttccgtatcaaacagagccagccattaaggtaactttgttgctacgtgttcctgtctcctatccatcttgtcgttctgaaccgctgatgctttgctcacaagaccaaagtttacctggaaagcagagctgtgtacgcgtcgctggcgtgatcctgctccctgttcttcttcacggcaggggagatctccttcctcactttgacaagatcctccacagtgtggaaggacagcctgatgtaatttcgcttcaaacccaccaagtgatttggctataatgcgaagagatcacgctcattggttcaagagaaataggactttatgggtgagagggtaaacactcaaaggtaaacacacaagtcaaagagttggcgacttcaaggcaccttgtccaactctgcacgtggcaccaactaacaccactagagctctttggaaggaattttatagacggtcaccacaccgccccatcacccaacagatgacctgaatttctacctcttccgatcccacctgccaggaacaatgtagactctggcctcatttacccctggaaagtctgggtgatactcaccaagtccagatcctctttggggacagtctccacttttgcaattttgccctgaaacttcttggagagaaaagatgaaacttctcgctcacaaccctaatcaggatcagaatgaaaaggctttccattggtaaaatacatttccttccttgcctatttcccagttgcaaagcccaccacagaatgacacacaggtcgtctgacctgagtctatgaaacacactcacctttctggtcgcaatgtagaaatacggtttatagggcaaagccacctgttaagagtcaccaacccatccaggggtgatgagaaagaagaaagcgagagaaaagtgaaaacacattgcttgctcctatatcccatgaacagcctagggccagggtagccttgaccttggtagcatacaggaagtcagaatgcgcacttttcacaggggcaagaatctgaaagacacgctacttctcaccattcagagtcttcctgaactgacctctctcaggacatcttacgtgatgactgatggggcctccaggggcccgagttctgctgggctatgggctgctgtgcactggaagcctcccatgccctccctgacagtcacagagctacatgaacacccataaaagtgggttttagcttgtcgcagtcaggggcttaccttaaatctgcttccgtcatcttgaataaagtagtaatccactgcactgcctaagcgcttatcttcatctaaaatctcggtctacaagagaatcagtcaacacagacacaagaccatcctctacacagttagagaaactttcctcctacctttcgggaaactcagcactttagaaacaaaccctctcatctaggtctttactccacccctacattaacactaccagccttattcacaagaaccacactgtaacggcctccaaatggggatctctctcaatttctccctcataatccttgaaagctttattctgatggctaaaagagatgcccatcacctccggcttctcacagtggcctctctgtggccctcaatgacgttaaagaggaaaggagagctgggaaccttcacatctcccacctgattcactcaaagttccctcatgtgtcccccactctttagataaggaccacgctatgaccagaagggttgcagccatattcctgggtgggagaaggacctagtgcttacaggatgcatgttaatgagccagcctgtcttctcaccaggctccttcagccgctcaaaaccaaaccgcaaatccatcttatccgtccactgactccgttccaggcgcttgagtgccgaaactgaggaagtggcgccatcatccctgagtgaaagaagggaaccccgtgcttaatttgtaatgccacctgctgctgcttctttttttcttttttttctttttttttgagacggagtcttgctctgtcgcctaggctggagtgcagtggtgtgatctcggctcactgcaagctccgcctcccgggttcacgccattctcctgcctcagcctcccgagtagctgggaccacaggcgacagccaccacgcctggctaattttttgtatttttagtagagacggggtttcaccgtgttagccaggatggtctcgatctcctgaccttgtgatccgactgccacctacttctgcaaccctcatcccacctagtgttaagtgtttcggatatgacagggtatatatattcctgaaaaaccccgagcttggaaaaaggctcattaagataaaaggactcattggaaaaacacaattagggcaggcccttcaaaacctgttcaactttataaccagaatactaacaaaaagagtcatgatggctagacactgttgcctcttgggacactaaaaatgcataaaactagccagacgcggtggctcatgagagtgcatgtaacactgacatgatttgaataaaacagacggattgtcaggccaggcacagtggctcacgcctgtaatcccaaaactttgggaggccaaggcgggtggatcacctgaggtcaggagtttgagaccagcctggccagcatggtgaaaccctgtctctactaaaaatacaaaaaattaaatcccagcaccgtgggaggccgaggcgggcggatcacgaggtgaggagatctagaccatcctgctaatacagtgaaaccccgtctttactaaaaatacaaaaacttagccaggcgtggtggtgggtgcctatagtcccagctactcaggaggctgaggcaggagaatggcgtgaacccaggaggtggagcttgcagtgagccgagaacgcgccaccacactccagcctgggcagcagagcgagactccggcaaaaaaaaaaaaataaataaaaataaataaataaataaataaattagctgggtgtggtggggtgggcctataatcccagctactcaggaggctgaggcaggagaatcacttgaaccctagaggtggaggttgcagtgagccaagattgcgccactgcactccagcctgggtgacaagagtgaaacttcgtctcaaaaaaataaataaaataaaataagataaaataaattagatgggtcgtctcaatgtcaatttcttagttgtgacaattgtactctacttacacaagatgttatggtgaagtgatacgggaatctctgtatcatttctgacaaatgcatgagaatcaatctacaattacctcaaaaaaaggttgagggccaggcgcagtggctcacaactgtaatcccagcactttgggaggccaaggagggtggatgacttgaggccaggagtttgagaccatcctggctaacatggtgaaaccccgtctctactaaaaatacgaaaaattagccgggcgtggtggcgggcgcctgtagtcccagctactcgggaggctgaggcaggagaatggcgtgaatccaggaggcagagcttgcagtgagctgggatcatgccactgcactccagcctgggcgacagagcgagactccgtctaaaaaaaaaataaaataaaaaaagaacaagataaaaaaagaaaggaagacccttcctttgtctgaaggtattccttggatcaccttcaactcaagagcagaatgaccatattccaagactaggatccttacttctcatgaaagattataaccacttgtggtaggcaggcaggatgacaccccccatgaaagacccacatcctaatcccccaaacctgtgaatgttatcttacaagacaaaagggtctttgcagatctgactaaattaagggccttgagattctgcttagctgggtgggcgcagtgtaatcacaagaatccttgtagagtgaggcaggagagctagagtcaggaaggagaaagggatgggagagagagggtaggggggagaggagatgcaacccttggttctgaagatgaagaagcagcaaggaaacagattctcccccgggaaccatcacaataaatataaccaaccagacactttcatattacgacttctgacttctaaaaccgtaagagaataaatttatatagtcactaagtgatcatgtgttactgcagcaataggaaactgatacaccaccatactgtataataaaggtttaatcttttaaatagttgaatgcacccgtaatcaaaaacacagaaaaactatattccaaatcttgctagagaacagcctcagttctgagtcccagatctttatcaaaatcaagagtgaatgaagtgctatttacgaggcatcacctcttaacaggggcgcacggccctctatgccagtcctccaaatatccttgcctcaagtaagttggattaagtagactagaaaactgctcactgggaccatatttcctcccaaaactgctttctctgagctgtgtatctcacttttaatccagggacagtaagaaatctgaaaaatggggataagtgtcacacagggagctaccatcgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccactgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagctaccattgactggttactatatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagagctaccattgactggttactgtatcacaccgtcccagtactccacacaggctctcattcacagagctaccattgactggttactatatcacaccgtcccagtactccacacaggctctcattcacagagagctaccattgactggttactatatcacaccgtcccagtactccacacaggctctcattcacagagagctaccattgactggttactgtatcacaccgtcccagtactccacacaggctctcattcacagagagctaccattgactggttactgtatcacacaatcccagtactccacaggctctcattcacagagctaccattgactggttactatatcacaccgtcccagtactccacacaggctctcattcacagagagctaccattgactggttactatatcacaccgtcccagtactccacacaggctttcattcacagagctaccattgactggttactgtatcacaccgtcccagtactacacacaggctctcattcacagagagctaccattgactggttactgtatcacactgtcccagtactccacacaggctctcattcacagagagctaccattgactggttactgtatcacaccgtcccagtactccacatatgctctcattcagttttcatgacaacccctacgagggaggccactggtgtccccatttcacacaagaagaaacgcaggcaaacagcacccactgcctcctggggcacactcacctcccaggactgttttaaggatgagatgaggtaacccacataaagcatgtaaggtaaaagccatcacttgtacttatcccagcagcagccttccccctgcctggaggccatcactgagcttggggcagggcagtggagtggagcacgtgagtgcagtcctgtgtcctgaagcagggcagtcagtaaccgtctctaagctccaagttccaacacaccatgtagaccctaagggtacctgcctctctagggcttgcctgatatggacagacagcgatgagcacaacagcagttagggatccttaccacttggtttctcctctgggaagaattttgttcagctaagtgtctgtaaaaagcttcacgttctcacacgttttttctatttttttttttttgagacagagtttcattctttgttgcccagcctggagtgcaatggcgcgatctcggttcaccgcaacctccgcctgccgcgttcaagtgattctcctgcctcagcctcctgcgtagctgggattacaggcatgcgccaccacgccccgctaattttgtatttttttagtggagacgggatttctccatgttggtcaggctggtctcgaactcctgacctcaggtgatcctcctgcctcggcctcccaaagtgctgggattacaggtgtgagccaccgcgccgggcctcatccgttttctgcttatggcaggccagtcctccggtcatgtttaccgtttgctctggccaccaagcagccgcgtcttatccttgctctattttttttgagactgggtctggctccgtcgcccaggctggagtgcggtggcgcgatcccggctcacagcagccttgacctgccgggctcaggtgaacctccggctcggattcgggagtattaatagctgggacctcgggcgcgcaccaccagcctgtctaatttttcttgtttttacaagagaagggccgggcgcggagtctcacgtctgtaatcccagcactttggaaggccgaggcgggcggatcacctgaggtcaggagttcgagaccagcctggccaacatggtgaaacccggtctctactaaaaatacaaaaactagccgggcctggtggcgggcgcctgtaattccagctactcgggaggctgaggcagcgggatcgcttgaacccgggaagcagaggttgcagtgagccgagatcgcgccactgcactccagcctgggcgacagagcgggactccctgcccaaaaaaataaaacagaggagacgaggtctctctctgtagcccaggctgatctagaacaggatcctgggctccagcgatccgcccgcctcggcctcccccagcgctaggcccccaggcagggtccccggccccgcccctccccgcaccctccccagccgcgcgtccaccccgcagggcctggcccgggtcccgccgctctcatcgcccccgccgcgcggcaggtcccaaacgcagctgcgcggaaggcgaggcccgaaaaacctcagaaagagccgagcagggaaaggccgcgcggcccgcctcgtttccccgcaaagaagccgcgcccgtagcgcctccgcccgccccgagcccctccgtcggcggtcggggcgcgccgccctaccccagtcaggcgcggcgagtgcgggcggctgcgggaaccgggcctccctcccgcctcggcggcgccagccgaggacggccccatggcaccctccggagggccggcccgagagcctcaggagggcgcccctcacctgctggcctcgccatccgcgcctgggtccgcgcgccgccgcccgccgctcctcagagacatggagccgttggctaccacctctgcttcaggggagaaatttggcg

SEQ ID NO: 1915 - DNA, 5428 bp, Homo sapiens
tcaccataacatcatatttattggccctttatcaagctatgtacatggtgagacaggtcaggacaggcctccatttgtctcaggggcaaagcattgtgggcaaagaagacagagcagctggagctgatggggctccagttaaggcaatgaaggctttgccacaccatagagggctcaagggaagggtcctaaaagaccagccctgagcagcctggtgggaacagcctcttggccttctgcccagctcctggctgaagctgtgatctgtgtagctgtgactgcagggcttgagaatggcggagggcttaggcagtttggacagggtgaatcgggattagcgtgtaaacccagccacctccctgaaaaacagtctgaatctcccttttccatctgtctgatgcgtatccaatcttttggcttctctgggccacgttggaagaagaattgtgttgggccacatgtaaaatccactagcactaacgatagccgatgagctaaaaaaaaaaaaaaaatagcaaaaagaaactcataatgttttaagaaagtttgcgaatttgcgttgggccgcattcaaagccatcctgggccgcatgcgggcctcgggttggacaagcttggtctaatgggaatacgaagacagccctggctcccactgtgagaaccccttcagtccaagcatactggtcctttccaagctcactgttctcaccacacggccccactccggtttcctggaggctcccccagaagcatttgggggacatagtccaggcaggtgcctcctcccaggtggggcaagcacctggcatgatagcggaattttaggtggccatgattcaggttgcatctcacctcatgggaaccagacttgggagcctgatcacaggtgccaaggaggtcatcgtccctgccagagtcctgatcccagacctgcaacctcaggggcccccctgtggccaggagcacatccccaaaatccagccgcactgaccagatggggttgttattgtcccacacggtgctcgtcctcagctcctggccaccaaagaagagcttcacataggcatccgtggcagtgaaccagtccccccacaggccccatgcttggatgaaggtcacctccagctgggccaggcccctctgccgagggcagcagtcctgggtggtgaccgctgagccatggcacacacactggcatgggtctcgggggctcttctgccgccctggtgggcacggccggctgcagtccctccagcgagccctgtccgtcaggtactgactcagggccctcctcagtgcctcccgccgcgggtcctggctgtccagcagcacgtgcaggggttccagggtgtagtccaccaggccagggctgccgggcagcgagtttacccaggctgagtactgctcgggcccggcctggatcccgaacagcaggtcgttaatggaggtgtgatggccgccaaccacttccgagtggcgctcccggtaggtttggtggaaggaggccgtcatcttgtgcttcttcttcttctcctcacaggccttggcttcggcagagatgctgccgtggatgcctatgttgacctgggcctcgacagtcaggcagtcctccacctcgttgtccgtgagcccttccagggccagctcgcaggtgcgcagggcagtgagggccgatatgcggccacccagctccacagcccggatgaagtgggtgccgtagttggagataagcctgaggtaggcgggctgggtggaggcgttgaagtggtggggcaggtccccgagggccctcttgaagtcagggtgcagcgggggagtgtgtaccacatggaaactgcgagaagagagagacctcagctgggcccaggggagtatttcccccattcaatcaaataactccttcaggactgctcaaggtcacatgtaagtgggcagaactaggactggaacccaggggcccggctccagagcacaagcacagtggcacggggctggcaggaatgcctccgctctcacccctcagggacctcagtgctctgtataggtattttctcttttccttttcaaaataacatttttttctttccttttaattttcttattataaaagcaatgatcctggccgggagcagtggttcatgcctgtaaccccagcactttgggaggccgaggcgggaggatcacttgagcccaggagtttgagaccagcctgggcaacatagtgagaccccatctctattttttttttaagaaaaagtaaaaaagaacataaaagcaatgatcctgcactgatggtatctgtcgaactttggaactagtcatgtggccttcatccatccgtccccctggatgggtcccacatgcccgggatcctgacagcttgggccatgctcggcctctctgtggaggaaacgtggcccccaggtctgatgaatcagaccaggtgacttgggtctggcctacaaacactgtgcctttctcagacgtggaatatgggtcccatacttcctactcccaggggctagggtagtgactgctgtcgctcagcagtgtggccctgccacaggcaggtgtgagtattggttgagtggatgattgaagctcagagagaagtgagatgctcaaggtcacacagcgatgaggaaggatgacccggccaggtctcctgcctctgtccctatccaggaaggactctgtggaaggctggctgtgcccaggaaaggcagggttcagtactcactagacctaaatggcaccctgctgggactctcaggcatggtctcactcactttctctctacttgatgtctcactgggcactcccagatttgggacctcctggatgagaggaggccacagggctgaatcacctgaagtctgagagccaggattgcagtttcttcctggtggaagcagcctccaagtttgattggaggactctgcctttccagggctcctagaccacccagagtttcccgcgccttttccagccccccacccctagccccagctctcacctgtagaagcggcactccaccgtgtcagtgctgaagctgtactggtcctggtgggtcttctgggctgcaaagttggctgcctgtgagtgtgagccggccacagacacatgcacattgctggtgggcttaggagtcacgtccagcccgaccttccagtcgttgcggatgctacgagccgcatcccgggccacagcttcagtggagctgactttggccctggttacatggcgctggcagccagagccctgggcccgccagttggtgagcgccagaggcaggcgctggagggtgccctcctgtagggcattttcacagagggtgcaggtgccgtcgggccgcaggaacctttgtgtgtccactgggaaggagcccgagcggcggaggctggtcacgtccacaccctccccggccagccatgcaccaggcacgaacttgtggctgcgcttgcactctgagcgtgcggctgtgtggcacggggcagggacgggcaggggcagcagcaggagaaggatgcccaggaggagcagacgggctgccatggagctgcagagacagggggcacttgggctctgggaagccatgggtggagggatggaggatgactgctcccttcccccacagccacagattatcagggcacatggaaggggaggggctgagatatctcttaagtcattattcaatgaatgtcagagctggtatgtcccttataggcctggttcagcccccacattgtacagatgggcccagagaggggaaaagcccagccaaggggagcccctttttagaatttccctaaggcctaatggggatctaggtggatggctctgtccccaggacacaactgtgggtggtggggagggggctgtggccacagaagaggggacagagtagctgtagcaggtttagggaggggtctggggacctgaggaagccttcattctgaagaagtgtcatttttggccccagaacaagccaccctttgcccaccctgactctcactctgtttctttgtctctgtcactctctctaacctctctccctcccactgagcccttaacagaattggaagagaaatgaggtcctatattgcacctattcttctcattttccctttggggctctccctctgagctttatggaataacatcagcccgaattctagaataaaatctgccgacctggccaggtgtggtggctcacacctgtaaaccgaacactgtgggaggcagaggcaggtggatcactggaggtcagaagttcgagaccagcctggccaacgtggtgaaaccccctctttactaaaaatacaaaaattagctgggcatggtggcgggtgcctgtaatcccagctacttgggaggctgagacaggagaatcgcttgaacccaggaggcggaggttgcagtgagccaagatcgtaccactgcactcccgcctgggtgatagagtaagactctgcctcaaaaaaaaaaaaaaaaaggggcagacctgaccacacccttggattttgtgtggggagaggcctcgatggttgctcttcagatcctttcttgctgcccctcccctctttgccactccctgccaagctctgtggccttcggcagtgacaggggcccccctattgcctactatggacaatgattgtctggaaggttcttcctaattttaaggtgtttctggggccttgcctgggcctgtttatgatctggaacctcctttctctaaccttacccaagcctaaccttatccaagctgagctcttcaaaggcctttgcccttgggtaccacaggttctgagacaagagggctatggagagcccccattatagctggagcctcctgccctgcccaaaggtgtgacttgaagggtggaatttcaggcagcgtggctcgccccagggaggcaaagaggccaggggaatcttcaaaggccctgggctcatcccagctaggaggcgggcacagtcataaccctaatccagtgaactcagccctcatcctgactctcatggtattctgtcccagggagcctctttccagctttcttagaagctttaatgtcagcacttgcagggccttagaaactgcacgctacctcttcatttcatacatgaggaaactgaggcccagggtggacacagggctgcccagcgagttagtgatgggcaccgtctgtgacccaggtgtcttgtcttataggtcacagcacttcctgctccatcagcctcttcccctccacccagggccccaggccccccaatccctgctctctccttacctggaatcccgtatagagaagcggctacacagatggatatcctctcttcaccgaggctcctggaatggtggcatcagccccccaggcagcccactgtggctccttgcaccagccaccactcacatcacttc

SEQ ID NO: 1916 - DNA, 5428 bp, Homo sapiens; identical to SEQ ID NO: 1915

SEQ ID NO: 1917 - DNA, 31511 bp, Homo sapiens
tcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtaagtgagggccgggtccgggcgcgggatcggggctaccccgagggcgcggcgcccttccttcccccttcccgccccagttcccgtttccgaaactgagaaactgagccgcggtcagcgaaagtcccgccgcgccgagacctgccggtgactccgtccccctgtccgtctgtgtgtccctccgctagacagtgggggctgaggtccttctgtctgcccgctcccggcccctccacccgcccgtgtgtctcccgctcctccgaggggcccgtccgtccctcccgactctctcccgggccctgtgtccgtccgtctgtcgccacccactctgtgttctccccctgcgcgcctctccgagacccgatccttctgtccctcgccacccgatccgtccgtcccttgccctccgcgtgctccatcgccccacccccacccacacccctacccccgcccgccgccccctcgatcccgtcctcccggagccgcgcccccggcccacgctcgccgccccctgccagtccagccgcctctccgctctaccgcggggcccaggccaggccgcccgccgggcctcgcctcccgcccctgggtccctggaggcccgacccgcgcggcgcctcctcctcgctgtctcttctttcggtctcaagagtctttctcggtcccttcatccgtctctgggctgggcgtggctccagtctccaccatcccccttcccaccccacccctccgcccctctgagacccctcccagggtggcccctgcccgatacggtctgtactcgcccccaacccagatgccactcccgttgtgggggctccaccagatgaggggaggaggtcgggggggggggtcctcctggctggtggtggagcggcagaaggagagcaccatcggaactgctcccacttccccagttccctctctcttggggcaggggagagccccaccgagccccgccttaaacctggtcagaaggatctgctgtgagtgggcggggggtccccttctctgacgcctaccctgtatgcgtggaagctgtctccttgtgctaagtcactggtatctgggtgtgtgggtatgttgtgtgtctgtgtcagcttctgtgctgtctgtcactgtgggacttgcctgtgcatgtgtgtcctttttcgcatgtgtgacttgcttgtgtgtatgtgtgtatgtctgtttgtgtcctgaggctctgtgtgtgtcttttgcaactgtgtgtaccattcttggtgtgtttgttgtcaccagactcgtgtgtgtgtgtgtgtgtgtgtgtgtccttgcctgctagtgtgtgtgtccctgtgtgtctggaggtttcggtgttgcacactgggtatatcatggtgaccaactggccatgagtacgttagatctgttaattgtggaagcccctggtgttgggtgcctacccaccagtctcatgtgtgagtgtatctgtataagtgtgtgtatgtgtgtgtactcacgtgtggctctccctctgccactgagtttctgtgaccaggcccacctggtcactaagggaggggactgatccctggggtttcctcgttcctgctgtggagtgagctggggcttggtgagcaggccagcagagggaggctgtatggtgcatgtgtgatatgtgtggttgtgtgtgtgcgtgtgtgtgtgacagagaggtgtggtggtgtctgggcagctgtacctggctgatgggtggtgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgaggacaaaagttcctgtgttaaaggtcctttaacacaatcttggcccatagtgagaacacagcacatgtgaagtcttttgttgtcaccacccccagctatacggttcccattctcctgggagctggggctaaagaaagcccagacagtatccaacccaatttcctgcctgtctgttgccccttcccatctccttgaccaagcagcttgagggaggggggatgcccagacagagcccccagtacccagccctgttcagcctgcatgacagcccctccctcaccagaccttagtgtcagtagtagcgatgggggagacaggggtgggggatgattcagagctgtgactgcagggcgctgacaccatttagctggcacagtttagattaaaattagaaataatttaaagtacagacaaaaagataaagccaaggatgcctctgcccccagggaatggtgatgggggtctccagctgggggaggggttcacatctggggagcagaatctttcttagaggcttgagctggccttcagagaaaatgcttaggcctttcagccaggagacacagagtaccttgctacctttgccatttcttcctcccaggatatctccaggcctcagttttttcagctgtgtaatgggcacaatagtaatgtgagaatcacctgaactgtaaggcacaagagattaaaaaatgtcactcttcagtctgggcacggtggctcacacctgtaatcccagcattttgggaagccgaggcaggtggatcacttggtcaggaatttgagaccagcctggccaacatggtgaaaccctgtctgtaccaaaactacaaaaattagctgggtgtggtggcgcgcacctgtaatctcagctgctcaggaggctgaggcacgagaatcacttgagaccaggaggcagaggttgcagtgagccaagatcgtgccattgcactccagcctgggcgatagagtgagaccctgccacattaaaaaaaaaaaaaagtcactattcatttggcattctcaacatgagtccagcacaggagctggcacgccacatcattggaacctcagaaccacctggggagaagaggctagtagtttccccattaaaaaaactgaggctcagggaaattgcaccaggacataaagtggtggtactttgttgcaccctaggactcctaaacctgcaaggcaacctcccacagacaggagggtcaggaacaggtttttgctgtgttattggcttcctcaccaggctggaaatgtgctcagggcagggacacagtgttccagcccctaccatggagtggacaaatagtggtgcccaggaaaagttgggcccaacaccacatttcaaggaagggaaagccacatccagagagacccgaggttttaggtccaggagagactgaactgggcccgtcagccatgctgggactggtagacggggagagcctgtttggcggtgcctcccggctcagctgtttcctcctgttcctacaggtctgcagggaactggccaggcaagggggcaggcccgtttctcctggtggttggtgcgttgtagcagcagcgggagccaggactaaggacaagcaggagctgggagccccaggtaggactgagttctcttaggcagatggatggtgcaccggtgtagccttcctctctggcctctttgtcctttgctgtggaactggatggggttgggcatgcatgcagagtccttgatctggttgtgggccctgtgtgcccaggggccgcagctgtttgccctgtctatgaggggctctctgctcatgaggaacttcctgcctaacctggctgtggccccagaatgctctcaccttggagctcagaggcctggggcctaccattaatttggggcaaaaagtagtaacgcttttttggtcagttagagagggtggctcatgggccaaagattgagggtgggtgtgtcagcttttccatggccctgtatctgcctcaaactcacctcatcatcacacaaggacactgaaattccccgtgggccccacagtgggttggacactgcagggggatggaatggggtctccagctccaggtacagctgagctgtcttccacaccccaggcccctccattttccccagcttctctggagcccgagcagggctcagtccctctcttcagcttccagattcaaggggagctaggcagagtctggaacaatgctgggaaggctgcagtctctttgaatcccctcagaaagctagaaattccttgttttggggcgagccttgcctccttcagccctattaccatgaaaacattgctgtgggtgactccatactcattccaggctggtgactgggtgaccgggccccagtgaacagggtactggtggtgggtatgggtgctaatgaagctggagcctcggagtaacagtggggggatagcaaagaccgtctttcctccaggagtgctccctgagcagaccctcacagccaaccctactggctgttacgcacctataggtctgtgagtagagccataaaggctgggcttcctgggcctgactctgggttgggggcagaagggaggtcagggccttcactctggggtaggagttgggacagaacaggagcagtcttcactgggccttctgtgtattggacctgtccctaaacctggtgtggaggaagtaaagcgcctttggctgtctaggggcctctgccacctaagttctgaagagccagccctttccgtcactcagccttgttttgtaaggagtttgattagtcttggagacagcccactgtaaaccctcagacatcaccctccagctgcacagacatatgcgtgctcacacagggatatggcaagctaggctgcagtgggcatgcacacccacagactcatgagttcctgtacgtgcaccacacatgtgggcatgcaggtacacaggtgctcacatgcagccacccatggcacactcacacacacacagatgctctcccagttaccgttggcatccatgcactcaaatgcctgcccacacataccgcactgtgcccattctggggtcaggaaggggtccctggtcagagttacagcccagtcaggtcgcctgcatctggcacctgaggggcaagttccaggtgtggctgtgatctcagtaaggggggctgggccaccctggtaggtgggctctgcccatgcattcagcagccaccctgcccacctggccccaggctccaggccgaccagggattggcatgggagatgggaggcatgaatgcgggggagaggctgtgtcagctgtgccagcactgtgtgcctgctgctacagcagaggaagtaggctgtctggccatggggccaaggtgctcacagtgggtgggggtcctatcaactcctgtgtcccccacggtgtccatgcctagagggagtggagttgctgggctctagggactgagaggttggcaggggctgtctgttcacttcccaaagcctgggcctaggagagaggcccatctgttcaaggcgtttccggaggcttacttcctctgagctgcccaggaagtggttttggagtgggactgaccagccctctgtcagtggctctacgccttgctccgcccctgccttgcctgcccaggggagcagcgtctggccaccgggttaggctgactgaccaggcttttcactgccagggctgcccaggcctttttggggggctctaggagaagggcagggggcaggtcacgaagtcccctgcagtccccacaaccgtggctcctttcttgctctgagcctgtaagccgaggctcaagagcatcaactctggtaggcatggcccccttgagagaggtgatggctgggctgcatcttagtgactaggcagctcccagcagctctatgaatgaacctgggcaagtggctctgccgctcagtgcctcagtctccccctgacagatgagataatgatagcatccatcttgatgaggttgtgcggaaatgacagataacatatgcaaagtagctggcatcgtgcttagtgcattgtcagagttgaatgagtagaaactgtagttatgtaaagcatttagagcccagttcatgggaactattcaaaaaatagcaagtgggactgatgagggggtattattatctgatgggctgggcactggcccagtgttacatggccaggtggctgtggagcctggctgaggagccaggtctctgactccctcatccccctcaattctacctccagtggcagtgccctacttgttcagtaggttccatgccctccgaggagaggagctcctgttggagcagctccacccactcagcagtccagcccctgcctgctcttctccccctcactccctttcaaagggagaaaatagatctcgtgacaaatggatgcagggaggggaaaggcagtctgcagctgcctgctgccccctcagggctccccttggccctctccagctctggcctcctgcaggacattaggctgggagaattggctgggaacgagggggtggacgtaagccctcctgccagcctgcttacccttcagacccctggagtcagcctgtgggctggggcagggagtgggcatctgggactgatggaagctagaagagtagggggagctagaaaaccccctacacccatggcagctgggggcagggcccagcctgtcccagggacacgaagaaggtcagcacagttagggttgggctaagcattggccttcactgtgtggggcccagaggctggggatgaggagtgttgaggagtggtaaggacagtgatgcaaacagcaggggcctgagggctggagagcgaaaggtggatgggcctgggcgggaagtgtggttgagggtatcctgaaggcttaggagcaggacttctgcaggcatcagacagaccctggttgaatccttgctcaatatttactggctgtgcacacttgagccagggactggaccgttccccacttgcctcgtctgtgaaatgggcagatcacggggtgtggtgtcctgtgagacatgaacgatgggaaggagccactgtgtggggtggggtggagcaggaagacggaacagcaagcccagaggctcctaagcgggaaggaactggctgcttcgggaactgaaaggggtcagcgtggctggggcacaggaatgagggaaaggcagcgcctgcccgagaggtcagggaggtaacggtgatggggaggggggtggcggggggcaggctgcatggagcaggctgaggggaggagtctgggcttgtcagaggggcaatgggaggcactgggggcttgggcagggggtgacaaaatctgtctgaaaagccccgtctggtggctggaacagggggactgtcgggccggggtagaggatggagagcagtcagaagacaggtgcagagcctggggatggtggtggtgggagaagaggatttgagacttgaggacaggctgcagcggcagacgggatggccttattgtgtggggagcagggggagctgtctggcctgagccactgcctgagctcgtgcactcctagtggatgaggagcgctgggaggggaacggcgggggactggtgtgggcaggcttgagctcttctggagtcattcatgtggtgaagccagggaggcaggtggggccacaagcctgaagttcaggagggtctgggcccaaagtagagacgggagcctaaagccaggattggggaggagagggctcaacaggccttctaaggggtgggggagcatttgagaggcccacgaacaggactgggatggctgtccctcaaaggtctctgccaaggcacccaggagggcaggcttgtggtggctgagccgctgttttcacaacagctccggaagctttggatcatgtctatggccgtgttgggtaaacaggcagagcagagcaggcagtcgccaaggcctgaggctagatcagatgtctgcgtggtgtaggttgtgggctggggttgttggggtgggaggaggatcccagggtcctccagtgtcagggctggagaaagcttagaggtctccattgttgagacagggaggctggagccccgggaggggcagtagctggccagcctctgccagtggactcatgctgcctgcttcagcccagttctgcccagagcctcaggccagaacagggcaccctgcggctggggggcttaacagagcctcttttcccactttccaaggaagtctggaagacaccagagcacttgggccaagatcgcggagcacccaggcagcagatctgagctaggcctgtctaggtccaagctcgccggttcctctgtccgctgcctgctgtgggatggcgcaccatgcgggatggtcctgcctctctcccagctttctcaatatccccaaagtggggaagcatcatgtggatcctgcccagatcctggggatgactggcaaaagggttaggtggccatcttgccttctcccaaacacaaaacgattgtttccaatggtaaaccatctggaaaatcgtgggaactctgtgggagaaagaagggctaaggagtagggctcttgtactgggggctgatggaggagctgttcccatctccaaacacataccctcaccccattggaggccagatgggcagttctaggactagagctggaagttctctccccacttccccctgggtctgccccattggctttgtggctttggttgaattgctcaacctctctttcggtttctgcacagtgagcctggagctcaaggaacttgctcctggggtgcccggcttgctgccctaccaacataggttcaagccctcccctccccctgcgcgccaggcctgtgactgccacctgtgaccttcaacctccaccatagcctcagggccctgcaggcaggtgggcgggcgggcggaggcctgcccagtgatgtgcctgaccagcccactccttcccttacacactttagactttgctctggatcaagagggactttcttcgtctccctgggtggaaaggcccagcctagcctgacaccagctgcccttctgcccctcctccattccccagccattgtgcctgggggctgtggtggaaaaagctgcatttggacttcatggtgccagactctagtcagggatgtggggtccttccaggactgtatgtttgtttctgtgtctgcctggagcatctctgtgccagtgtgtacatcacagcttgtggcactccacgtgcgtgtggagcctatgtggtcgggtgtggtctgtgtgggcccgggtatctgttgagatgtgagagccggtgagtgcatgtgtgtttctgtgtgtgtgtgtgtgtgtgtgtacgtgtgcccctgtgtcatcacagcagtgtgtgtacgtacctgtggctccaactgtgtgcgtgtgtgtctaatgtcgagtggggctccctatgtgctgtttgggttggcgagtgtgcctgtgtgcacacgtgtggttattcgtggagaggcccggctgcatcccccaccctggctcctcacagaggccccttgtcctcacaggatctggctctctggctcctgccatgaaggggcctttgttcctctctcaggggtacctggggcaccgccctctgactgagcccaggactcctcatatcctagggctggctggtgactcgaggcctgtgcctggtggcctccctccaaggaggccctaccccacacaagctggcagaggtggatgtgagccgatgacagccaggctcccaagtcctgcccctctgaaccttccagaccctctggcagggcaggccattatgctcctgctgacccctcagatcgaaggcccccagccaacaggtccctgcagcctccgttctcctccagcccccctcactccctgctactcactgcctgcgtggcgcatcctacagaggtcttaccatcctttgtaatcacatatttatgtgactggctcccaccaggctgtaagttccatgggcctggtgtggcagaggttaccagtgggaaagcagctagcttcctgagaggtgggaagggtcccccagggccagccttctgagctgcctggaaggatctgtgggaattcagaaggctgttccagctgagggaacaacatctgcaaaaatatgggggctgggaaatgagacatatgttcacagagtagccagaacagggattgaggtagagagcaggacagggccagggagtgggcagtctggaaggcctggagaggtctgggctttctccaggggcagtgagagcctaggaggttcccagctgtgggaagaatgggtaggggagggaccagagatggtgacaaccgggagggagctgggtaaggggaggagaggccacaggtactggttggtctgtgtggggtgagggaggggcccaggaggagcgctggctgggggatgaggtacctgtcctgggaggagcaggtatggggagcatccctgctctgggacttggctgtgacctgagtccatagatctggttcttatctcagcacagggctgggcatgtggaggctgggggatgggccctggtggaggaaccctaaagggtcttgctagcctttcccctcccacctcctgttcctcttgctgagcccacttcctgggttgtgaaacctgcatggcctccttgccttgtttccgctgggaaggccatctaggcagccagcctcccagcccagctaccacccacctgcctacccaacctggcagctccaccatgcccggcccccttgccctgccgtgactgccggtaccagtcctgcaccctcctgctgatcacacttcctctcactgtcctttctgcccctgcctgggccttggtctcctccgccctcctttattcatccacaaggctctggcaggctacactgtggactcccccaggcagagtctgcatccttaggagggccctcactttgtgccacctgccatgcagttgtgacttccgtggcaggtgtcaggtgtgtgggggagaaggctgcagtaggtggcatgggggacatcccctgctccccgggggtctgttcaagggaaccagaccgccctatacccaccaggggctgcaactggtctttcattgcccttgctttgactgacctcagcctgtcacctcatttctcccatagacgtttctgaggcagcctccctctgctctcacacacctccccgccagcagcctgatcaagcctctttcctccagcccagcttactcctctgaccaacaggcatcattctgtggcctgtgaggcagaattgaacaccagggaaggggtggggtggaggggaccaggccggatctgggagccagggaacctcactgcaggaccttggccttagtttcctcctctgtacaatgaggagatgggcatgtcagtctctgaagacctatctcttgtggagagattgttggggtttttcacctttgacaaaaccattatccaacaagttacatgtgatgcagaaaaattagcaaatgcattcctgttcctgctggcgctcctcaggccatgtccctcaccccagcctcctgtgctggtatacatcagcacacgtgtggatgtgcagcacacatacttgtctgctggaggcaaccaggacttctgtgcccgggagctccaaacccaaggtcgctctgatcaccttgaggccagccttgcccactgccgggtactggctgggaacaggtttccatttgtcccagaggaggtgacctgccttctctggcctgacctagctactacctttccttacctctgggctgctgatctggggctcacattccctggggctgggatccagtgtgtccaagccttccctaggttttgtttttgttttatttgtttttagtttttttcagacagagtgtcactttattgaccaggctggagtgcagtggcaagatctcggctcactgcaacctctacctcccgggttcaagtgattcttctgcctcagcctcccaggtaggtgggattacaggtgtccgccaccacacctggctaaattttgtattttagtagagaaggggtttcacttgttggccaggctggtcttgaactcctgacctcaggtgatctgctcacctcagcctcccaaagtattgagattacaggtatgagccaccatgcctggcccttccctgggttttggaaatggaggctggtccaagtggcgaggtcacgggggaagaccactggtcaagcatggggtacctgtctcttggagcccttacctccctgttttctctgtcttcatgtgtgtttgtgtgtgctgatctccacctctaccgtcttccgtccatctctacccttttctctctctttgtctcttcttcccaacatggcatactggaaaggacctgggctgcaacatcgggcaggcctggatttatccttccatcacttactggctgtgtgaccttttggaaagtcactttgcttctctgagctttagtttcttcatcagtaaaatcccttctggatccgcatagggataacgtgagctaatgtaattacagaggtaatctgcgacattgtcggcctcagaaaaggactgtccttcttgtaagtggaggagccaagattcatacctagacactgacccttagtctggtgctttgtgcttcataaagctgcctctgctgtaggctggagaagcagaatagagactaggagcccttaggcagctgggaaaggcctggctggcctcagctggctccaaggagcttgtccccatggaggctgtgtggggtcgagcccccggcaccccctggccctgcagagtggccatgagtctggggctgagccagcggccttcctctggggcctccgtggcccaggtcctatttgcatgggggctataaatagtcagcacaccttgcttttgtgctgctgcttcacccccatctccctgccatacactctgagaggtagggggcagactctgactctgctgtgcagagcagggacttgtggctcagagaggcccaggacctctctgagggtcacacagtgatggaagaagatgtggggctctgggtagtacaaacagggacagagttggtggcagaacctggccagagcccatgccctggttttagtcttaggaggttgggtctgacgctatggttactgctggttagtctcagggcagcccacgaagaccatggctccccagttctcatggcactgcagcctggcagtgcaggtttagggctggggcctgctgtgtttgtggttttccctccagtggcttctaaatgtgagcagcagctgctctgagtgtggcctgagagagctggagggccacccttgggtgggcaggtcctgggctctgcctcaccctcctggggcttctctgacccactgtctcctccaccctccatgcagtcctggggtggtccccacgcatacctcctgctgggcaggccgggggtaggggaagccatggagcctgtgggctgtcagggctgggccccaagggttggtggctgggaggaggacctggctggccggtgttggagcatctggtgctcctgagtgagttgtatgttcatggagacctggtttccctttctgagcagtgggatctgtaaccaggactgtcttcccaggctgctgggcaggcggaatggatgcggtgggggatgcgagtgcgctttgtaaactgcgaagggaggtgcacagtgagggatgggtgccgcagtgaggggggtgatagtggtaagaggaaccccctccccatggcctgttgggttgattgtagcccttatcctacgtgagttctcattatccccacaaccctgagccaagagactattgctcatcaggaaatgggggggctgaggctcagaaaggtcaagtgacctgcacagagtccacagccaaggcaacgttggtgtcaggatgcagcacccaggcggcctggccatcattttgccatatgtgctgccctgagcctctctcccctaggagcccaggccacctgcaacacacttgctcctcctttatccctgtgcccctgtcccctcaaccctcatcatcctccgaggcactcagaagttgcctactgccccatctgggtctccaggttttcctaacagcagagctgcatctgctgggattaggccctggatgtgtggacacagacctgccaatcattccagacccagggagcactcacctgggtgctggatctcttggaccctcagggacaagccaggcagcaaaaggggcaagatgtccatcttgcttacgggtttgggatgctcacccagattcctgcacatgtgcgaggccaggcccacgcagcttgcttttcactccagtatcaactgagtgcccaccatgtgccacccactcccatggctgtatataatcacattcctgtagacccgtgcaacctcacacacaccgattcatgcatgctgcagcctggggagcagccagcagcagcccccaactggccctctctccctggcccaccaagaggtcaagggcagctggcctggcacacaggccacctgctggtgtcaggctgaaggcttcgggacttgggctcaggcatgagcttgcacacccactctcacatccactgagtaggagccagggccgggcaaggaatgtggtggggtctgcccctgccctgcctgggtcctgctctctgctttggcagctgctggcctcagagggctgcctggactcactgggctgggctgcagggtgaggtcagcatttgctgtgagctcatctgagctgggagctcccagcagagctggccactgctctggccaccttgtgcaggagctggaggaagtcatctggggctgggcagctgttgtgtgtgcatgcacacgtgtgtgtctgagtgtgcccctgtgtgctggcttatgttcaggatggagtgaatacatgtgcatgtgcacaaaatcgaatgagcgctccctcaaccaaggctatggagcagccttgtggggcctgggcaggagccagtgtgcacataggtgcttgcacacctgtgtgtccttcacaagtggcaacctgaggagccccttggagtcacttactgtagtgaacattaacttagagaatggtgagaaacccaggagtgtgggaggctgctgtgtatgaatctgcaaggcacattcagcgttacattcaacattaaaatacagtttgggttttttttaatttttatttttctgaggcagagtctcgctctgttgcccaggctggagtgcaatggcgcagtctcagctcactgcaacctctgcctcccaggttccagccattcttctgccctcagcctcccaagtagctgggattataggcatgcgccaccacgcctggctagtttttgtatttttagtagagatggggtttcaccatgttggccaggctggtctcgaactcctgacctcaggtgactcgcctgccttggcctcccaaagtgctgagattacaggcatgagccaccgcgcctaggcagtttgggttctttttttaagagatagggtctcactctgccacccatgctggagtgcactgcgtggcactctgctgccttgaactcttggcctcaagcgatcctcttaccttggcctcctgaagtaccaagattatgggagtgagccaccatgcccacctgttttatatttggggaaataattagtttgaaggtgcaggcaaccttccaggcaagcgagaggcactcgaccccaaggggtcaatttagaagggtcaggcacactgatgtgggcagagcctctcactgccctgatccctgaacagagtgggtgccaagttagtggaatgtcagcttttggttctgattctctgccttagggtttcagtttccccatctgaaaagtggggggtgtttatcttggcactgcttgtctgcctgggtagttatgaagaaaaaaccccaaacttagaaaatcatgaagggctgcatggggcaggatgggagaaagaggcagtactgtcctgtccccttaccaggtgacaatggcacataccaggtgcctggcatggagcaggtacccagcaatagggtacttagggagtcactgagtgactccccaaatgaatatctaggggtgacagatgcaaatgccaccagggcccaggtaggaggagtgaagagagtgcccctggcctggggtagattgatggagggcagccatcccagtgctagctggctgttgcccagtgggcccaacatcacattttccagttttaccagagacgccgcaaatccagacttacataaacctctcaatatttttctttttctttttcttttttttttttttttgagacggagtttggctcttgtcacccaggctggagtgtactggtgcgatcttggctcactgcaacctccgcctcccgggttcaagtgattctcctgcctcagcctcccgagtagctggaattacaggcatgcaccaccacacccagctaatttttagtagagatggcttttcaccatgttggtcaggctggtctcaaactcctgacctcaggccatctgcctaccttggcctcccaaagtgctgggattacaggcgtcagccactgcgcctggcaaacctctcagtttttaacactggcaactgagactagtgtgtgtgtgcatcatgtgggccaaacccaatcatagcagagccctgggggagcgggtccctgagtgctgcccgtgactgttcccgctggtcccgcccggccgcctggcctcacccctctgtgtgcacagccccactgcaggccccaccatggcgccgttcctgcgcatcgccttcaactcctatgagctgggctccctgcaggccgaggacgaggcgaaccagcccttctgtgccgtgaagatgaaggaggcgctcagcacaggtaggcctggaggctggaccctggagaggggctgggaatctgggcccagctggaaggactggagggggcctggccttgttccctgcaacctctgaaggattctgctcttcctcatccttgactccctgccccactcagctatgaaggcagaggccactgagtcgctatagggctgcaaacactggccaaattgagccctccttggaaggcttggagtttctggttcctcctccctggttgttttacccagcaatttttacatgtccatttgtgccagggcctgtgcggggcactgaggatactgtcatgctccaggactaacctggccctgccctcatggggttcatagtcaggtggggaaaccaggcacgtcaaaaagcagtgagtcctgcaatagggaagcccagagaaggcaccctctgaacctgaggtcagggaggacttcctggaggaagcacatacctcacatcattccctcttgcttttgccctggcctggtgaacccctatttgtccctcaggtctcggctgaactgttccttcctctaggaaatcttccctgacccttaggcttgaccctgtagcactaccagccttgccctcttcagtctcatcacaactgtgacttaacagttacttgaggaaggagttggtgcattcgccacccgggcctggggatccaggaggacaggccctggatgtagcttttctttcagctgtgttctgcgcctcgaatattatggctggcatgcaggagctgtcagcccatgttccctgcatgaatgcataagggcaggcgacatttaaatggagctggagcaagaggatcagaggaagagggaacagcaggaacaaaggcctggagggaggacctagcagggtgcccaaggtagttctgtgctctagaggacactggggaaccacagcaggccctcaaggcaggagagtcgggcagattctgccaggggaaggccgtggaggtctacgagggagggacagaggggccatggcccaaccttctctgcctggccttgttgcagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctgggtaaggggcgcacgagccgtgccgtgtgtgtgtgtgtgtgtgtctgtgtgtgtgtgcatgcgtgcatgtgtgtgcgtgcacacacgcgggcttggtcagtgagcacagctgaagagcaccgggccctgtgctggccaccagtccagccctgtggccaacatgtcctgggtgtgaatcctggctctgcaattcaccagattcccagcctctctgagcttctgcttccgcatctgttaagggaaggcgctactaaatgtgcctacctcagggtcagttgttcaaatgaaaggagcagctggatgtacagggcttattgcagaacctgacacatagcaggtgctaaagacggccaacttccttattgtgactactttttcctttttaattttggaaaggcaggatatgcacatagtaaaacatttttaactgcatgaaagggtgtgtccctgccccaacaccaggccaccaggcctccttcccagaggcacccattatcccagttctttttggaatcttcgcatatattctaggccttggcagccattgagggggcaacatagtgatctttaacagcaaggaggtgggagaaggggaggctgacggtctcatctacttacctgctgaaatggagactctgcacaagcatgtggccacttggccatgtgcagctgtgtgttctgggtggccacaggatgccagtgctggcagaagtcccctggggttacatgtgggatgtaaccaagatgtctccaccaggaaaggccctgtgaccattggaggctctgatcagcctcctgcgaggggtgagggggctgggatgggagagaggttaacacagggctgtactgacccttggccagtcaggcagggacacagaggggcctctggctgtgctgtctccgctcccccaagggaggatatcagtcaccaggtctaggtcttgggggaggtgaggggatagaggctcaggtcccaccctcgagactgtccaatctgcatgaggagccctcggcacagagggaggagcagcgtgtgtgcacgaggatgagtgtgtctgtgtgtctgtctctctccgcatgtgcacacgggtaggggcctccattctaagatccttgctaagggagctgcagcgggtaggggtggggaatttcccttcccgctctattccccagctatgtgtctgggctgggtgtgggctggaccctttcacttccctaaatgtaataatacccctgggtacagggtgggggtggggctcaggagtggggctcaggcggggccctgcccacactgggcagacaagtgtctggctaggccttggggggctgccttggccttgggggaccagccatgggggtgggttctgagtttggcctggcccaggctgccctcactgaccttgttctcccctggcctctggcccccaacagctggacctgcagcctcaggccaaggtgttgatgtctgttcagtatttcctggaggacgtgggtaagaactccctgggggtggagggctcccttgccgggttcagaggcagagccagcactgaggtgtagggaagctgctcccttcggcagagctgtccaggaccaccctgggagggactgtaggggtgccaccccttccagataccagggctgacttccctactccatggtcaccagattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggtgagaaccggccatgcccactggtggtggtgcagggtagtgggggccgatcccggtccccgctcactcactttgcctgggttttgcctttcaggggcctcaacaagcaaggctacaaatgcaggcgtaagtgtctccacaggccagtttgtacgtatgtacccatgtgtgctcacgtgtgccagtgcctgtgtgtatgccagtgcctgtgtgcgctcagagagtgtatgcacgtgagttttcccagtgtagatacagcagctgagttcagtgagtgctggggctggcttgctgctgctctggaaaaccagttctgcgcatctcttcccagctccgcattcagtgacggggagttggtggatggcaattgggcacagtagagtattcacgcagaaaccagcccaggccatgcaccaggcctcttttcctcggagaggcaatgataggtcctttactggcacatagtggctgcatgtgcttctgtgtagatgtgggtgtctctgagtacacaggtgtgagcacactctgtccctgagggtgtatacacgaggcgccgcaggctggagtcagactgcctgggtttgaatcccagctctaccacttcctagctatagggccttaggcaaagttacttaacctctctgtgcctcagtttcctcatctataatttttttttttttgagactgagtctcattctgttgcccaagctagagtgcagttgtgcgatctcagctcactgtaacctccctctccaaggttcaagcgattctcttgccttagcctcctgagtagctgggattacaggcgtgcaccaccatgcccggctaatttttgtatttttagtagaataggggctttgtcatgttggccaggctggtctcaaactcctgacctcaagtgactcacccacctcagcctcccaaagtgctgggattataggcgtgagccatcgtgcctggccctcatctataaattagatataactataatgtataatagggtcattgtgaagatcaaatggaataagatatgtaaagctgtattttaagtgccttccactggtagccgctctgtgtaagaagtctgttatcattattacacatgctttgtgtgtatgtacaggtgtctgttttgaggcgtgtccatgtgcatgtgtaagagagggcatttaggagccgtttgctatcccagggcttggaagaactgcccccgcttctcatattgcgatgccctgtgcccgctaacttctgcccacctccctgcccactaggactccttctttctaagcccctgcagattggcctgtcctctccgccccgtcctctccaggctcctccttcgagggctggcaggaggaagactcaagcgctgggcctctgcggggtgagggtgtgggcggtcaggagaacggtggctttgtgtagagggctagactggtcggcaggcaccagctcatagactctgcccctcccggtgctttcccttccccctcctgggcctgtgcctcttcaagaatgtaacgctgccatccacaagaaatgcatcgacaagatcatcggcagatgcactggcaccgcggccaacagccgggacactatagtgagcctgggtccggggcagggctggggatctggggggcttggccagatgggagggatttgcaccctctccccaccctccctggggagcttaccctccctccccatttttcttagtctttccttgcctctcccagtggagctctcttgggatgttgttgtgcccagggttgggggagagctaggggttgaagaagaggctggagctggcacgtgaccctcagcctgtgatacccccacctccagttccagaaagaacgcttcaacatcgacatgccgcaccgcttcaaggttcacaactacatgagccccaccttctgtgaccactgcggcagcctgctctggggactggtgaagcagggattaaagtgtgaaggtgcgtgccaccccgcccctgggctgcaggaggggcactcccagctggtgctgctgtgaattccagccacctcacgccaccctcgcctcctcacctggagacgggcacctcattcagggacctgatgagggtgaggccttggtggaccctccccactggcctgactggctctgccacttacctgctgtgtgaccacaggtgggcggctccacccctctgagccatttggaggagaaaagcaggacctagagagtccctgtgaggggccagtgggcagagggtgctgaagccaggcctggtgcacaccgacaggcgcccagacaggcctcccctgccctctgcttcacttagagatgagacagaagaccctggagggaaagcggcttaagttgaccagatgttctttaaagggtttcgaattaggtccctgtcttctggtttttcctttttctttaaatcatgaaagattggctgggcgcggtggctcacgtctgtaatcccagcactttgggaggccgaggcgggcggatcatgaggttaggagatcgagaccatcctggctaacatggtgaaaccctgtctctactaaaaaaatacaaaaaaattagcctggcgtggtggcgggcgcctgtagtcccagctgctcgggaggctgaggcaggagaatggcgtgaacccaggaggcagagcttgcagtgagccgaaatcatgtcactgtactccagcctgggtgacagagtgagactccgtctcaacaacaacaacaacaacaacaacaacaacaacaaaaatcatgaaagattgaaatgcttggccgggcgtggtggctcacacctgtaatcccagcactttgggaggccgaggcaggtggatcacctgaggtggggagttcgagaccagcctggctaacatggaaaaaccccgtctctactaaaaatacaaaattagccggatatggtggcgcatgcctgtaatcccagctactcaggaggctgaggcaggagaatcccttgaacccaggaggcagaggttgcggtgagccgagattgcgccactgcactccagcctgggcaataagagggaaactccatctcaaaaaaaaaaaaaaaagagagagagagagagagatcgaagtatttatgatggcttcagatcaatgttttcctagaaactggaacccagcagaccccactgaagccctcctttctcttgctctcctgcgcctctcctacactgccccctgcccttggctgagctctgagactgacagccccgcttctccctcaccccagactgcggcatgaatgtgcaccataaatgccgggagaaggtggccaacctctgcggcatcaaccagaagcttttggctgaggccttgaaccaagtcacccaggtgggcaggtgccatggggaccctggacacagggcagtggggtcagggacagtcaaggcttacagccactgctggggagccacagacagccaggatatatttagacccaggactctacttcgggaagatgcaactcaagaatttaggcagcagagggaggggggctttttttcataagaaattcattattcaggcagttctttacttgagggtgaacctggggaccacaggagtgggtgttggaacactttgaactaagactttgggtgtggacgtttgtatgtggggggggcttgagggatgccacaaaacctaaaggtaaaattttagaatcaatcagaaatgaagctaaatagtcaaataaaatctatcgagtgagtggttgggaaggtagggttccgtttacaaaacttctgtttgtaatcagagcctttcagaccaccaaggcttctctgggctcctggaagagtgcgtgtgtgtacacgcagcccgagtagggggcctgggctgtgcccctgttgtctcctcttggtgttaagggtggagttatacctgggagtcttccttctgggctgggagttctgataatggtctgaccatctggccccccacctctgctccctccccagagagcctcccggagatcagactcagcctcctcagagcctgttgggatatatcagggtttcgagaagaagaccggagttgctggggaggacatgcaaggtgaagctgggtccattgccccattacggtttttattccccctgaggccaaagaaaggggactgtcctcccttccattgtcaagtgagacatggaaggaaccaccggtcctggggagcgagccccttcctctctgaggccccttcccccagcctaccccaggccccgggggaggggagttgtgtagactgagaccccgatctgaggaggtgccatctctcgggcagacaacagtgggacctacggcaagatctgggagggcagcagcaagtgcaacatcaacaacttcatcttccacaaggtcctgggcaaaggcagcttcgggaaggtgagggctgtgagccgggcacctgcttcccaccccaccctggcttcttcccgcttaggtggctgaggtgggagtctgtgaatcgggctgtggcccctgccccgtcctcacctgctcagcacccgtgtctccccatcaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggtgcccgggcctcctgccgtcaccaccccatgccacagccatgtcccacagctcctcagcccccctcagtcagggctgtgtctccccttcaggccacttaaggcagggccatgctttcccccctcatgcctcccagggcagagtcgtccacctcagccagggcctgtccctgctgtttcctgttggggcttggccccagtggccctcagtgagggagcctcctgcctattcctcacccctgctcaccacccttcccaccccaggaccacctgttctttgtgatggagttcctcaacgggggggacctgatgtaccacatccaggacaaaggccgctttgaactctaccgtgccacgtacgtaagggccatggtggggaagggcccagtgtggaggaagggctactggctcagagcccacttccagtctgccctccatgccttcttccctctccctagaaaagccagcctgggctagagcggcaactggggagatgtgggggtagcctgggtcggcaccacacaggaagccatgggtggcaagtgaactgcggctgggtgcgcagcgcaaatactctgggtcctggccgctccgtgggccacagccagggcagccttgcaaatggtggtcctgcatgacacaggacacaggaccctggtgcgtggcccccagacctgcttctccccattcacatgccccttaccccaaactaaccgtgtatgtgtgtgtgtgtgtgtgcatgcatgcaaacacatatgtacatgcatgtaaatgcatacactcttagagaattggctcactgagagctttcccttcagaactttctgcctgggctgccagcccccacttgcctgatacaagatgtacttgatcatgctcaggtggtccatggagttatttgcagcatttcttgctcctggaagtggggttgagggcccgaggagaagcagaggctgctcggcagagatcccggaacactttatccctctctcttgcccaggttttatgccgctgagataatgtgtggactgcagtttctacacagcaagggcatcatttacaggtgcgggggtgagggcagcgggggctcttgggaggggaggctccagccccatcatatcttctgaaatgctccaagcaggatccccccaactccagttccttctctgctggaaatcaatctttagctgggtatttgcctatgcctcccaccctggtgttagcattcctgtggccaccatttgaggctggctcagcttcaggaactaggaactcactgctcatatttgacaccatcgccccacccatccttggagccgtcagtctcgctctgaagccccatcgagtcatctaagcttctgccagaagggactccttccataaagtctcatctaataagttatgattccatcctatggtgggaactgtacacccaccaaaaaggctgaggtcaggctctgtatactgatgtgggataatgccaagatatgttgttaagtggaaaaacaacctgtgggaaagtgtatatcgaatattagcattcagcctttaaaacgtgggagggagactgagcgcgatggctcacgcctgtaatcccagcactttgggaggccaaggtgggcagatcacccgaggtcaggagttcgagaccagcctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccactgcactccagcctgtgtgacagaatgagactgtgtctcaaaaaaaaaaaaaaaaaaaaaaaaaaaggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgctaggggaccctgggcgagtgacatcacctgtttgagccccatttgggcttcaggaagtagggcagtgtatgcccagcgtttagcacacagtaggggacttgcaagaagcacctgtttttaggatctctttctccttctgcttccttttctgtttctcattcccttgtacccttggggacagtcctggactaatacggctgaaaattaggacatggggggcagggttggaaggagaagaaatgtcccctgctgactcttacctgtcccctgtccttagggacctcaaactggacaatgtgctgctggaccgggatggccacatcaagattgccgactttgggatgtgcaaagagaacatattcggggagagccgggccagcaccttctgcggcacccctgactatatcgcccctgaggtgagccgatacccttccagccccccgctcagtcaggcaccttgcctccccacggtgggccagggaaggattcccaagggcagtgatgtccaagccaaagcccataggctgaggcggcctggctaggcttcgtgcccaggggcccctctcagcctcagcacctcagctcctgctgacctgctgctctccccaccgccagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaaggtggaggccctgggctgggctgggctggtctgggctgggctggggcaggggctggcagacactgggctttgggtgaggagcttcctgtctctggaatggcagcctcagtggtgctgcagtcctaacatacggggtattgctctctcaccatgttcccaggaactcctgtctgagtcctgtgcatagaatcagcctgacatggtgactaagggcccagggtcaggagacagacccgaggccaaatgctggctctgcctgggactagctggtcacttaacctctcagagtttgtctccttatctgtaaaatggggctatgagcagacttgactcacagagttgttgggaagaaaatagaaacatatgatgctcagctgtgggccaggcagatagtaaataataaaaagttccaccagcagagtcgcagatgtccagcccagagcctgtcatctccgggggagctgggagcactgcaggccagagtggcctccctcagccccaccgttccccaggctgactggggctggggcaagcctggctttgcatccctgggcctgctggggatttgctgaagctccaatttcccatggcccttgggtgctaaccagggtccctgctgggttgcagctctttgaaagggaaccaaccaagaggctgggagtgaccggaaacatcaaaatccaccccttcttcaagaccataaactggactctgctggaaaagcggaggttggagccacctttcaggcccaaagtggtatgtgatcctgccctgtgctgccttcaggctgagctactcctctcctgccctccctctctcctgcatcattcacacgctttccacctctcccttcttccagcaatctccatagcatgttcagtcacagccgctgcccttgtattctcatcctctccctcctgactcagtcattcagcacacactggggactgtggatcccactgtatgcagaggaccctgttttgggaaatagagttaagacctcactttatcgctccattcaatccattttccaatacatatggggaatcctgagtccctgttgaatgcagagcacagtgctgggctgcacagcaaagtgggagatgcagtcccagaaccggaggagctctcagctagttggagagataagaaacttgcacacctatgacaatttgtgatacgagatgacagtataagagatgccccaggacacatgatccgttgctattgagtgggtctgtcagcaggaacccaggtggcagagaagagggtgggtctgagaggccccgttggaagaagtgagacaagggacagctgggaggcattccaggtggaagaggggctggttcactcacaggcccagaatctacagggctaccaaggaaccagcctgagagcagaggcaggtggggccactaagaaatttggggctgtgtggcccctctgtgaccacagttcttccttcccactccccttctgtcctttgattcccctcctccaccagggcacacagttcccactgggcagcctgtgtaatgcgccccacatttgtgctttgaggctacagagcacttcccctacaccagggacctcaaactcagacgtgtcctggctgagcatgtaactgacaggctaggccagctgcaagaaaatcacacagcctgctttcagtctcacttttgatagatttccttctccgcactaagaaacacaaagcaggtgtgatgtaccccttgtcagtggggcaggggctgtccagggggctcttagcaccaagagtgggcaggaagtgggcccagggctgctttaatctgccagttttcaaaagaagctggaaatctggatttttaggttgcattgctcaattttaaaatataagttcaggccgggcacagtggcccacaccagcactttgggaggctgaggcaggcagatcacctgaggtcaggagttcgagaccagcctggccaacatggtgaaaccccgtctctactacaaaaaatacaaaaaaaattagccgggtacggtggtgcacacctgtaatcccagctactcaggaggctgaggcaggagaatcgcttgaacccaggaggtggaggttgcagtgagccgagatcgtgccactgcactccagcctgggcaagagagtgagactccatctctaaatgaataaataaataaaaataaataaataaaatataggttcaaattccattaaaacccagtacaagccgaaatgattgtacttgccagttcagtttggctgaagggccaccagcttgcggtctttctatattaccatcccatcatatcctcaggagcagagaatcagcaaatttctcctgtaaacagcctgatagtatatattttaggcttttcaggcttgatggtctcaaagcaggcatagacagtatgtcaacaaatgggcatggttgtgtattacaaaagctttatttatggaaagtgaaatttgaatttcacctaattttcatgtcatgaaatatttttcttttgattttttttccaaccatttaaaaatgtgaaagccattcttagcttgtggtccccacaaaaacaggtggtaagtgagcctccctgggctgtgattcggtggtctctgagcaagaggctaccacctctcctaacccaggcccagagctccctggtcactttcctcatcctcttggggaaatggcagcctccttcccatggggctcctttcaggctgctaggggaggctctgtcttctgttctgggtgaggacagctctggcctggcccagccctgcagggactccagcctggggtgtctggagggccattccctaggtcctgttcgctcacccctgccctctgcttgtagaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaggagcacaagctgtttgaaccaccaggtttatttgtgtgtctaaataaacaccaaatagtaccaa

SEQ ID NO: 1918 - DNA, 31511 bp, Homo sapiens; identical to SEQ ID NO: 1917

SEQ ID NO: 1919 - DNA, 187075 bp, Homo sapiens
tacttttggaaaaaaactttattaaacactcaagagtatacttctcaaaatcacagaagagcctccaaatacaagtgttagaaggaaaaaaaaaaacaacaaaaagctaaaagccaatcagaaacagtttgggtgtggaggactggcggggggggacagggactgcacatgggaaggagccacttttgtattccataatttcatcttgttgtgctagaatgcatgctttttttcctccaaatgaggaattcatttcaaataggaatttcttttattctcctggaactgaaatgcttagtactatccctaacaacaaccatgggatttttgaagttatcccaaattcaatgcaaagcacttttatgtatcttccagttgtagattggaatagcaaaagtgaatgctatgaccaaaatttttgccctcctaaataaagacgtttccttctagagagcaaatctatcataaaatgtcaaaactagaagagaataaaatgaaaggaaaaaacctagaaaaatatcctaaaatatcaaatgcagtcatttctaaatataagccataattatagctttacctattgttcttattgttcctatgctgcttctacaatgttacatcaactatacttagctttactctcccaaaatcttggtgatgaagccttctgagtgtgctttccaatgtgccagaaccagaagggcattccaaggcttccccacatttcctccatttacggagacagctgtttcactaacttgcagcacttgtaaatgctttgaaagctgatcacatattatattcttgacttaatactttggtaagcctggatatctatctttctataaacctcacctaatctttgatgttactataaccttatctttgatttaacccatacacatttactcatcataatcttgatttaaactcatgctacgaaactgtagcacaaaagacatttctctttagtgtttcaggaaaatcagctcatggaatgctgccaaccaaagtatagtagattctttaaacaatgtaatgctttctatctgcagactcccacagacctcacatccagggctcccatccttcccaggttctgccaaggatgttggggtctgttgcctggtccatcaggcacttcacttgagtctcttctgaaagcccactctctggttcttgggcacgaatgttgtgatctttgcttcctcgtgccacagccacatagtctctgaaggcaggggccttctcatgacccaggagtagctcatcactggaaaaaaaacaaacacagaaaacacaaagcatgtgtcattgtcctttgttgcctgcatccctagtgatcctatccaaacacattccccacgtcatcactcacagagtattttctgtggcttataaccttgaagtcaaagactggatttgtaggaaaacagaacatgaattatgctgctcaagtttttgtgtgaatgtatgccttcacttctcctgagtgaattcctaggattcacctaggagtggcattgatgggtccaatggtaactctatgtttaactttgtgaagaactgccactttcccacagcagctgcaccttttcccactcccaccagcagagtatgaggagtccaccttctctacatcctcaacacttgttagattcctttttttttaattaaaaaaagagaaagttttaaaaatttttggtagagacagggtcttgctatgttgcccaggctagacttgaactcccgggctctagttatcctcctgccttggcctcccaaagtgctgggattacaggtgtgagccactgcattagccccattttaaaattatagtcatctggcaaggcgtggtggctcgcctgaggtcaggagttcaagaccagcctggccaacatggcgaaaccccatttctactaaaaatacaaaaattaccaggcgtggtagcatgaacctataattccagctactcaggaggctcggacaggaggatcgcttgaacccaggaggtgggggttgcagtgagtccatatcgtgccattgcactccagcctgggtgacagagcaagactttgtctcaaaaataaataaataaataaataaataaattaattaattaatagccatcctagcaggtgtgaggtagtatctcacttggatttccctgatgactagtgacgttgagcatttttgcatgccgcttattggccatttgtatattttcattaaagaaatgtcagttcaagtcttttgaccatttttttttttttttttttttttttgagacagggtcttgctctgtcacccaggccggagtgcaatggcgtgatctcggctcactgcaacctctgcctcctgggttcaagtgattctcctgcctcagcctccctagtagctgggattacaggtgtgagccactgcgcccagccctgaccatttttaattgggttatctatctacctattattaggcaataagagtttttttaatgtattctagatacaagtcccatatcagatacatgacttgcaaatattttatcccatttggaaggctgaaacaccttcttgatagcactctgtgaagcacaaaattgtttaattttgatgaagtccaatgtatatatttgtttcttgcttgtgctttcagtgtcatacctaaaaaatggcaagtatcacaacaaaatccaaggtcaggatgatttactcctattccttttttttttttttttctgaggcagagtctcactttgtcgcctaggctggagtacagtggtgccatcttggctcactgcaacctccgcctccccaggttcaagtcattctcctccctcagcctccctagcagctgggattacaggtgcgcaccaccatgcccagctaatttttgtatttttagtagagatggggtttcaccttgatggccagggtggtctcgaactcctgacctcaagtgatccactagccttggcctcccaaagtgttgaggcgtgagccaccacgcccagctgatttactcctatttctaagtgttttatagttttgactcttacacttagctctctgatccattctgaattaatttttccacatggtgtgaaacaaggacctaacttcattcttttgccagcgctatttgttggaaaggtcactgaatggtcttggcacccttgtcaaaaataagttgacaatagattgccactattacttaattctaaagtccaacttttttcattcctatgaatcatctccataaatttctatttgctttagacctcaacaagagaaaactttaaggctaacctaaaagccaacccaaattgaattctcatctaacaagcccacacagtgcttttcatacctaggtactatattcatcagggtcaaacgccctaaaaaggacaaaagcaaatttaaaacctaagtctcctcatgcatgtaacaatattctggcaactgtctaagagtgcaccttctgtttctccaattggcgccactgttccagggactgagtttaaacctgaagacagtgcaggggtcacatacgtcagagttgcaggccttgccctggctttggggaagtcagcctctctaagccctgctttcctcctcaatgaaagcagagaagtcatgctaacagagtgtcaagagctcagcactttgtatatatgttggctcctcgagaaacagtagcatgtcggtagtccgttagttttttccacatataaaaatcttaccaagtaatgactgctggattggcacctgctaactttctcttagcgtaacatattttctgtcgggggtaccaatttttttcagcaacatttatttcttgaatccatgaccctccttttttcagcattttctgttcaaaattctagaagaaaagaacatgattttcccggctgatcataatggtatatacaatcatgcccaaacagattaaatctagtaatgatcttaaagtaaacaaacatctataaccaggagcagccttgctttctacagctacaaagctgttcatacagactccatggcacacacatcacgagacgaggggcctcagcagtccccttatttctccaaataaaggttttgcctgttaatttttttttttttgaggcggagtttcactcttgtcacccaggctggagtgcagtggcgtgatctcggctcactgcaacctctgcctcctggtttcaagccattctcctgcctcagcctcccaaggagctgggattacaggtgtgcgttaccacgcccagctaatttctgtatttttagtagagacagggttttaccatgttggccaggctggtctccaactcctgacctcaggtgatcctcccgtctctgcctcccaaagttttgggattataggtgtgagccactgggcccagcctcttaactggttttcaagcagacaatcctaaatactaactttgagaaatgctgtacaaaataatgtaaatattttcatcaacatgactcaatgcacttccatcatacacgagagataccagcttgatcacggggacactgtcacaaaagtgaaaagtgcacatgaaacaaaacctactttccaatcaaaggagggctccttgacaaacacatccatggtgttggtgagcaggccagggtctgagcggaaggcccggagtgcgtgtaccatgatgctgtacataaggcccgtttctttcattggtaacatcagattgataaactggcgagttagccgaaaaggcatcaactcagggactggcagaaactaaacaagaaaaaaggcaaggagcagaatatgtaagccagaactctcaaagtaccgagcacaaatggcagcatcctcacatagttactgttcacatttagtaaaaatacagactctgcttcccttgaaatcagctacacagatgtgagttcctatgctcgagagtaaccccctcggcttgagttatccctcaatgcaaaacccacgtgcacaggacacagggccgcagagattgagaaggatgatccaaaacattcagaggttaaccagagaaaagatctgtatcacatttttgaccagacatttttattacggggcttcctaaaactttcttagagtcttcctttgatctgcgaacacatttaattaccggctctgatgatatcactgatcaccatgacttctgtgacctgactgaatgaggctgaactaagtgattatccctttctgcattcaatgaccatgacaaaacgaatctaactaatatgttgtttttccttaaaaactgtctatttctggaggttgttgaaagtcctatgatgactctcgccttgcccaggatcacgagagcacagcaagtgcacctgtgtagcggatccaaacgcatgcccaaagtcgatcccgatcacgccgccagtctccatggccaccataaagttgttcagatgtctgtctccaatcccgaggatccagtggctgatgcatatcagagcgtgagagctggcgaagtgggagcggagcgccaggaaagcctcagggcttgtactcatcctcacgaaggcccgcctacaaaagagacacagctgtgcggctgctgtgatcccactaagggtgagggcagaagggtacttactttaagagatcagcaggcactttactttctcgttttctaaaagacgtgactgtttcagtacgattagcgcccctatgatttaataatagaaacatctaattagaaaaaatttctctgacttaaaatttaaattttaaaactttttgtttatattgagactcaaatatcgaataatcttgatgatctctctgaggcaaagctaagaatcaaaagaaaacatgcaatttgcagaagaatgaactaactaatacaaagaaaaatcaaaaccaaacttacttatacattagcatgtaagctccaacatcatgttttcctgacatttttgtcagccaatctttatattcacacggcggtgccctgggatcactaatgagtgagaaaaggggaattggaattaggaagattttagcattatgtgatttcaaaggcaaagatcaccaagaattcattgaaaaatagcaaagaggcaggaaaaaataataagacttttaaccatattcaatattaacattgaacccacattactctggatcttgaatttcaatataccattattcattcttaattactcctaaagaaatccaagctattgcctatgaaaaattcaggtacaaaaccatcagatccaacaaatttcccactgacatagagaggaataagatgaactaaacataactgtttattaaccaggcatgcaattctgaaactttgacctagaaagaaccatagcaagagggcgacagcaccacaggcggctgctggaagcctcaggccatgtcactaccatagccaaaaagcccgcacagttttgctaaagatggattatgtctgtttttatctttatttagaccacttccacatctttttcttttgtttttttgagatgggagtctagctctgtcgccaggctggagtgcagtggtgcgatcttggcccactgcaacctctgcctcatggattcaagtgattctcctgcttcagcttcctgagtagctgggattacaggcaaatgccaccatgctcagctaatttctgtatttttagtagagacggggtttcaccacgttggccaggctggtctcgaatgcctgacctcgtgatccgcccgcctcggcctcccaaagtgctgggattacaggtgtgagccaccacgcctggcctctttttcttttgttttgttttgtcttttttttttttttttttttgagacagagtcttactctgtcgcccaggctggagtgcattggtgcaatctcggcttgctacaacctctacctcctgggttcaagcaattctcatgcctcagcctcctaagtggctgggattacaggcgcccgccactacacccagctaatttttctattttcagtagagacagggttttgccatgttgaccagactggtctcgaattcctgacctcaggcgatccgcccaccttggcctcccaaagtgctgggattacaggcgtgagctactgcgcccagccagtgccacatctttctttatatttccaataggtagatatacacacaatccatagtaagtatgagaaaatattttgtttttcttttttcttccaataaggcttctgcactcctatgagaaaatattttcttaaatgacaatggatgtttaagtgaacttgaaaagctgttttcagtgtttcctaggaaaaaggcagtacctgggcaatgggaaacaatgtgatacacgtatgtttaagtacttttgtgtggaaagctttaacaagttttcccgataaaatctaaagacagaacagtttcacgtgtgacttagcaattcaatcacttcaggtgaaatcttttctgagttgctattaaagttagctttaaaagtagtccactccatcttaaaattctctcctcctagtttaaactgagatgaaaattcttaggttataaaactgtaggccgggcgcagtggctcaggcctgtaatcccagtactttaggaggccaatgggggcggatcacgaggtcaagagatcaagatcatcctggccaacatagtgaaatcccatccctactaaaaatacaaaaattagctgggcatggtggtgcacgcctgtaatctcagctactcggaaggctgaggcaggagaattgctggaacccgggaagcggagaccacagtgagccgagatcacgccactgcactccagcctggtgatagagagagactctgtctcaaaaaaacaaaacactgtaacatgctgaattaagaaaaaaaacagcaaggatttaaataatgggtattggaagtgccctgtaaaaaggcagttggaaattattttcataattccattatgtaaggtgctttcaactctcctggtacctatgttaatcctgtgcggttccacgctaccattccatcccacaaatgcaggcaggtaccacaggaaaggcgacacctgcttggcacctgcattgtcaggcagagcctcagtgccagggccagatctgcaatttgtgagactccaggaagcgtgctcatcagttgccctgtcttccagggaaagtagaaacaattctaagcaaaggactcaaatgtctggaactaaaagttggtgaacactgccctgtagagtaattatcacctgggaatatgagtttgataagaatatgtttgatattttcagaaatctttcctgactgaagggaacactgctcctatttaaaaacttttaaaaaagaatcagagaacatcaaagagaaagaagccctgaagctgttcctttatcctacagcttgtcacccaaacctgtcaactttggttgtcaaaatctgtcaaccctcaaaatgtttctcatgttgtccttgtttttctttacaaaaacaaaaaggaaataaaaaaaaccttgtggttaaaatgtacatgttaattgtagaaaacttggaaaatagagaaaaggatacagaaaaataaaaaagcatccacatcatgacctagaattactagtaatcccagctaccccactttacaggctaagtgacacaggacaggttacttgacctttctgggcctcagcttcctcatctgtatagcagtgataataatacttaccttgcaggttgttggtgagaagtaaattggttcatacacgttaaaaattgagaacagtacctagcccacagaaaatgttttactacatgttatctgataattttattattatttatttccttcaacaatttttcttccccccacccaaagttaataaatattttgtattacggtaaaatatctgcaactactggttagcagccagcactccatttggtttattgacccagccagcagactgcggggcaggcagtgtgggctctcgagcgcgcctgtcacggccccgacctgccactggagaagtgaggggaggcgactgctgggggagcagggcgtgtggccgcccttacctcaggtaagccgccttctcctcttgggacatggtgttcaaaagaaggtccttcaaggtaacagtattttcaagccactcaattaatcctaacctgaaagggagaataaaaggttaacgagtaaacccaaactgctctttcttcactagaaaaacagtcccgtggacgccaagcaatatgcagcagcctactggctgggagcagcctggcagttacctggaggtcatgggcacaacgctataggtcctcagctgcagggccctctggctgcaggcggagtcttgggccaggatcccattcatgacctggaagagctgctccacgcgctggtcctgccgcaggtcctcgccacccttcaccaggaaagggtgttccctctcgtcatggccacggatgatgatgcgcttgggccttcgcagagacgccatgactgtcaccttcaaaaatcagaatgtcatctcagggcacaggctagccacgtgtcaaactcagagggaaaagccagagtggctgtgagcattcctccgtggggccgccctctgaagacagtgccaaagagcagagcgcccaggccagcaacgaatttctgctacctgcttgtgcctgactgctgtgcccgcagaaatgttgtattcctgattataaatacttgcttatgaatgtggatatctttagcaagcagcaacagccaacatgcaaactttctacagtagtaagctaatgctacacatattttatagtggatactcacacacagcttactctttgagtttatgatatcttaaatagaactgttgttcaaacactggagacataatatattaagaaacccagggccgggagcagtggcttacgcctgtaatcccagcactttggaaggatggggcaggtagatcacttgagctcaggagttcgagaccagtctggccaacatggtcaaaccttgtctctactaaaaatacaaaaattagccaggcatggtggcgcacacctgtatcccagctactagggaggctgagacatggagaatcgcccgaacccagggtgtggaggttgcaacgagctgagaatgggccactgcactccagcctggctgacagaatgagactcttgtctcaaaaaaaaaaaagaaaaaaaaaaaaaaagcccgggcatagtggctcacacctgtaatcccagcactttgcggaggcggaggtggatggatcatgaggtcaggagttcaagaccagcctagccaacatggtgaaaccctgtctctactaaaaattcaaaaaacagagctgggcgtgatggcgtgcgcctgtaatcccagctactcgggaggctgaggcaggagaatcgtttgaacccgggaggcagaggttgcagtgagccgagaccgtcccattgcactccagcccaggcaacagggcaagactccgtctcaaaaaaaaaaagaggaattcagtaaatatgctaaacttgatatatctgtgatcaacatgggccgttgtctcatatactaaaggcaaacagatcattctcatctgaagaacgttcatcaggacagggactgggtcacacaccctcacacctacccgctcatcaaacccggcgattcgcacgtggtactctggcaatggctttcccctaccgtcatactgacctaaaacaaaccagaaccttgcttaggaacagcttgttagacaaccgcctgtattttaaaacatgcctcttgatctactttttaaaaagccaatctaacatgataaaaccttttactgaaaagttttcacttaaagggaactgactttaaaaaaaatgttatttctcggccgggcacagtggctcacgcctgtaatcccagcactttgggaggccaaggcgagcagatcatgaggtcaggagacagagaccatcctggcttacatggtgaagccccgtctctactaaaaatacaaaaaattggccgggtgtggtggtgggcgcctatagtcccagctactcgggaggctgaggcaggagaatggcgtgaactcgggaggcagagcttgcagtgagccgagactgcgtcactgcactccagcctgggtgacacagcaagactccatcgcaaaaaaaaaaaaaaagttatttctcattttgactgattatggaagttagcactctattctaatagcatggacaaatcctaagtagaaaaaatgatgcattgactagaacactgcatattctcaaggccaatcaagctgcatatgacaaggctgacatttaaatgtttttcttgaaatgaaccatatgcaactgcatagtcattattaataacaaagaaaagtgtttctccaaatatgttttttcttatacccactgaaatgagaatatgaacaaccagattaaaactttttttcctctggcaaattcggggtgaggaaaatggaatgtacacaggtttcctctgaaaaagtcacgccttgaaatctggccaatttgctgtgcatctctatccttaatattatgatcttttttcctgcaggtcagtgacttatcattaacttgtcacttttttttttttttaaaaacttgtcactttaaatggaactgtgtacacatcccaggaagtaatctgcctctatacctgtatatttctgaagaaaagttattcaggagcatagcatgaatacattcagaggaaatctatgattgctgtttaccattattaccaaatgaaaatctgaacttttgtcagaatcagaaatataagaactataatctcattaaacatttagtaatgtgtgctcattcataattatggattttcctaatgatgaaaaattcggtgaattttaaaattctttaaaaaaagaaataactgtcaatatcccagtatcactattccagaaaccacgagttcttattacagtgctgtgctcctgacagtacagttttgtcacccctggaggttaactcaccgggaatctccagctcatttctcaggaactccactttgaagtcgctcatccagggtgaacattctttcagattcccagggggctttgagtctttgttcatttttaaaagtagcatgttggtaatgtcgttgaagtcactgagcttcattctcagtagtttagaacctcctttcccaaaatgtttatcaaattcttttccaaaagtctgaaattagtaagaatttactataaagactgatgtttagtttggactttggaaaaggctctaagcttataagtgtaatgaatggagtgctcaatggtatatgtttcttctctgcttttaagatgtatagttttggttgggcatggtggctcatgcctgtaatcccagcactttgggagtccaagatagtaggattacttgagccaaggagtttgagaccaacccgggcaacatagcaagaccccaactctacaaaaaataaaaacattagctgggtgtgatggcacatgcctgtagttccatctactcaggaggctgaagtgggaggatcgctattgagcccaggagtctgaagtgacagtgaactatgatgatgccactgcactccagcctgggtatccgagtgagaccgtgtctctaaaaaaaaaaaaaattatagttttgctttccttgaatatttcaatactctaaaacatccagtctgccttttgtttcttgtgttccattataagtgacacggttaatgcctgtaatcccagcactttgggaggccgaggcaggtggatcacttgagctcaggagttcgagacaagcctggccaacattgtgaaaccctgtacccacttaaaatacaaaaaattagtcgggtgtggtggctcatgcctgtaatcccagctactcgggaggctgaggcaggagaatcacttgaacccgggaggcggaggttgcagtgagccgagatcgcgccactgcactccagcctgggtgatagagtgagactccacctcaaataaataaataaatgacatggttgaccaggcgcggtggctcatgcctgtaatcccagcactttgggaggctgaggtgggtggatcacgaggtcaggagctcaagaccagcctggccaatatggtgaaaccccatctctactaaaaataaaaaaaattagccaagcgcggtggcactcgcctgtagtcccagctactcaggaggcggaggcagaataattgcttgaatccgggaggcggaggttgcagtgagccgagatcatgccaccgcactccagcctgggcgacagatcgagactcagtctcaaaaacaaaaaacaaaaacatggttagtagtgacttttagttataaatcctaataagggctttaaaaacttggcgaagtcatttaacctctgtgcactcattgtctagttagtggtctacatcattatgatgacacaaataactaggaacaaagttaaaaacaacaaaataaaggaagtagttcaatagaaataaatggctcataatttctgataccagctgaagagaaaaatttaagaatgctactttctttattaagagtctttcaagctattattttgggtaataaaccagaaaaaatattatttaatcttttttttttttttttttttttttgagacagagtcttgctctgtcacccaggctagagtgcggtggtgcgatctcggctcactgcaacctctgcctcctgggttcaagtgattctcttgcctcaccctcctgagtagctgggactacaggtgcacaccaccgtgcctggctaatttttgtatttttagtaaagatgggtttcaccatgttggccagactggtctcgaactcctgacccagtgatccgcccgcctcgcgctcccaaagtgctgggattacaggtgtgagccaccatgcccagcagatatgtttatttctaaaagcaattattataagtactctaccttagaatatagtaattatctctttgcattagcttctactcagatatttacttgaattataaatctgatatcaaataaaaaataaatctcaagagcattactagcagttactcaacagttgtcaagatttacctgatcatctctaattagaaatgtttttaccaaatttgtaactaatgtcacaacataaatctggtgtaaatcaaacgtgctctattttaagacaatccactataggaaaattgacatatataaaacagatttcttctttgatctgtaagtggatgaaaaatgtagaaaacaattttcaattcttagaaagattagctatttccaaacataatcagcatcatcctatctgaaagacataatgcccttaaggatcctctaaagtgatatttgaggcacttcgctttggtagattattctttgaacgaatgcaagttatttttgatttggtacaaggtggaaaagttctggatagattttctaaggtactagaaataaaactccaaacacatctcctgcctgaaaggaacaagggaggcctttctgcaccctgcaggcttgggcaggatcaggtgctgctgcaggggtaagaactgtgctccccatggacagccctgcagggaagtctcagggcttccagcaacaaagtggccatgaattccgacacaacgtgcacactggctgaggtagcagtgtgctgggggcaggctaggctggaggctatgtggaggccctgctgctaatgggtatgggtttcttttttctggtgatgaaaatgtactaaaattgatatggtgatgatttcatgactctgtgaatatatgtaaaactactgcattgtatgctttaaatggatgacttaaggaccatgtgaattatatagtaacaaagcagttatttaaaaaggataaagctcttcctttgccctatacatggtggaacttgagaactctggcaacaagagttccaagacttatctatgcccttaaatttcttgaggtttaatgaataaaagtaattttgacaaaaactagaaagaaaagtcagtatgacccatgctaaacagagagattgtaaagtaagctgttttaggtgagagaggaagaacattcgactcttctggagatccctgcgtggggagggttgggaaaggctctaaaggagaaatgatgctgacgccaagcccaagggcaagtctccagatggaggagggagagaaggagccaagcaggctgcaaaggtgtagcaactgggctgactgcagtctacttgctccatcattctcatcaaatgatggtgtgtttcccttccaactccagcaccctctgaaagatctcacacttaccacacttgtcctaggcacagctcttggtgagcagttttgtcacataacccctttgtatttggggactggatctgtcttctccatgtatctcctgagcacccagaactgtgccccgaactaagtgcttgaaaatacttatcagcttatttaacacacaaatattttcttggcccaatattcaagccatttgaagaattggaaatcccaatctatatgtaactttcagatctaaaaatctgagcatgaacaacgtgtaatgaaactctgaggttttacctactgactcacctgctaccagccgacctaaaaatgttatcaatgtgtcacagaaagcatgagacctaaagcattcaacagacattttaaatgcagaactgttaaattaatgattacatttaatacaaatattattacatttaataatgtaactattgactgtcacaacgactctgctatcaaaatagcaggctgtgccagtccatacctgaataaacttccttctaaaggcccccaggcctggagcctttgggtcacccaaggctgcatacattctttcatacattttttcaatgttttttttatttacaggggtttttgctagttcagctcttacatcattgctccaatcctgtcaggggaaaaaaaaagtaagaaaaaaatcaagctagattgcaattaagttttacccaacttatatgttttatgtgccagaagccgttctatcattaccttaaagagcagttcaggattagagagctgatctaaggcattaataaaatcttgaatcactcctccttgatccaacttacttttaatcctatttaaaaaaatttacaaagtttaggcaatcaaatatcttccaaaaatcaatatatattttatataccatacatatataagttatatattatacatatataaaataatgtatgttatatataactaagtataatttatacatatcatatatatataaccaactacatagtaatttaaaattccacccaatgttaaatgaagcaagaagcatctattctatcaagagatgaggttcttaaaaaagaattaataccgatcctactcaaactattccaaaacacaagggaggagggaatacgtccaaactcattctacaaggccagtattatcctgataccaaaaccaggtaaagacgtatcaaataaaaggaaaactacaggccaatatccctgatgaacattaatgcaaaaatcctcaacaaaatacttgcaaaccaaattcaacagcacattaaaaagattattcatcatgaccaagtgggacctattctagagatgcaaggatagatcaaatcaatcaaggatagatcaaatacacaaatcaatcatatctacacaacagaataaaggacaaaaaccactgatcattttaacggatgttgaaaaagcatttgataaaattcaacatcccttcatgataaaaaaaactctcaaaaaattaggtatagaaggaacatatctcaacacaataaaagccatgtacaacacactcacagctagtgtcatactgaacactgaaaaactgaaaacctttctctaagatcttgaacatgttaaggatgcccactgttattccacatactactgggagtcttagctagagcaagctgacaagagaaagaaataaagggtatctatattagaaaggaagaagtcaaattatccttgcttgcagatgatacgatcttatatttggaggcacctaaagactccaccacaaaaccatcagaactgataaattcagtaaagctgcagatacaaaaatcaacatacaaaaatcagtagcatttctatatgccaacagtgaacaatctgaaacagaaatcatagaagtaattctatttacaatagccacaaataaaagaaaatacttaggaataaacttcgccaaagaaatgaaagatctctacaatgaaaactgtaaaacatggatgaaagaaattgaagaggactcaaagaaatgcaaagttacttcatgttcatggatgggaagaatcaatactgttaaatctgtccacactacccaaagcaatctacagagtcaacacaatccttatcaaaataccaatgacattcttcacagacataggaaaaataatcctaaaatttgtatggaaccacaaaagacccagagcaaaaagccaaagccaccctgagcaaaaagaataaaactggcacaatcacattatctaacttcaaattatattacagagctatagtaacccaaacagcatgacactggcataaacacagacacataagccaatggaacagaatagagaacccagaaataaattcacacacctgcagtgaatccattttttcacaaatgtgccaagaacatacatcagggaaaggacagtctccaataaatggtcctgggaaaactgggtatccatatgcagaataatgaaactagacccctatctctcaccacatacaaaaatcaaatccaaatagattaaagacttaaacctaagatctcaaccaataaaactacaaaaacaaaaacaaaaacaggaaactctccaggacactggtctgggcacaaagatttcttcagtaataccccacaggcacatgcaaccaaatttaaaatggacaaacaggaggatcacatcaagtcaaaaagcttctgcacagcaaaggaaacaataaagtgaagggacaacccacagaatgggagaaaacatttgcaaactacccatctgacaaggaattaataagcaaaatatggccgggcgcagtggctcatgtctgtaatcccagcactatgggaggccaaggtgggcagatcacgaggtcaggcgttcgagaccagcctggccaacatggtgaaaccctgtccctactaaaaatacaaaaattagcggggcatggtggcgcctgcctgtaatcccagctactcaggaggctgaggcaggagaatcgcttgaacccgggaggcgcaggttgcagtgagcagagattgcgccactgcactctaccctgggcaacagagcaatacaccgcctcaaaaacaaacaaacaaaaaacaaccaaaatacataacaagctcaaacaactcaacaggaaaaaaaaatccaatctcattttaaaatggggcaaaggatctgaatagacatttctcaaaagaaaacatacaaatggtaaacaggtatataaaaacatgctcaacatcaatgaacatcagagaaatgcaaatcaaaaccacaacgaggtatcatctcacccccagcaataacgaatgctggtaaggatgtagagagaggaacccttgtatactattggtgggaatgtaaactcatacaaccactatgaagaacactatggagattcctaaaaaaactacaactagaagtaccatataatccagaaatcccactactggatatatacccaaaagaaaggatatcagtatgatatctgcactcccatgtttattgcagcactattcacaacggccaaaatttggaagcaacctaagtgtccatcaacagacaaatgaatgaagaaaatgcagtacatacatgcaatagagtactatttagccataaaaaagaatgagatcctgtcacttgaaacaacatggatggaactgaaggacattatgtgaaataagtcaggcacagaaaaacttcacatgttcttactcatttgtggaagctaaaaattaaaacaactgaactcgtggggaggggaggtggaaagcggggatggttaatgggcacaaaaatatagttaggaaaaacaggatctagtatttagtggcacaacagggtgaccacagtaaaatttttttttttttttttttgttgagacagagttttgctctgtcacccaggctggagtgcagtggcttgatctcggctcactgcaagctccgcctcccgggttcacgccattctcctgcctcagcctcccaagtagctgggactataggcacctgccaccatgcccggctaattttttgtatttttagtagagatggggtttcaccgcattagccaggatggtctcgatctcctgacctcctgatccgcccacttcagcctcccaaagtgctgggattacaggcgtgagccaccgcacccggcctgactacagtaaatttttattgtacatttaaaaataactaaaagagtataactggaatgtttataacacaaagaaatgataaatccttgaagtgatggatactccacttaccctgatgtgattgttacacactgtatgcctgtatcaaaatatcccatgtaccccataaacatagacacctactatgtacccataaaaattaaaaattaaaataaaaaaagagctgctcttagataaaagcaaatcttgcaactgatgttgacgttttgacgtatataacgcgatatatagtttctgaagttacattatgaaagaaaaggtcactttttaaaaaacaggttctcactatgatgtccaggttggactgcagtggcaactcacaagttcagtcatagctcactgcagccttgaattcctgtactcaagcaattctcccacctcagcctcctaagtagttggaagtacagtcacgcaccaccatgcttagcttatttttattttactattttagagatgagatctcactatgttgccaaggctggtcatgaactcttggcctcaagcgattcttccacctcggcctcccaagtagttggtattataggcacagaccatcatgcccagcaaggtcactttcttgacacactgtctctcacatctttttctcttctttcatttttcaagacaatagctgtctgttcagagaaacagtatggtgggcagggcctcagtagggcaggggtgtgttcacagataagccacccattaactgcaacagaagctgggcctcagctgggcatggtggctcacgcctgtaatcctagcactttgggaggccaaggtgggcggatcacctgaggtcacctgaggtcaggagttcgagaccagcctggccaaggtggcaaaaccctgtcgctactaaaaatacaaaaattagctgggcatggtggcacacgcttgtaatcccagctactcaggaggctgaggcagggagaactgcttaaacctgggaggtggaggttgcagccgagattgcactgcactaggtgacagcacaatactctgtctcaaaaaaaaaataaaaaataaagaaataaaaataaaaataaattaatttaaaaaaactaaaaaaaaaaaaaaaaaaaaagatgccagcgcttttcttcatcttgttgaaatcaatacattcaaaataatgaggcagatctgctcataattaaaaacaaacaaaaaaccccaaaacctcatgatggagaatgtcactacaacactacacagtttgtgtacaaagcatccttgaaatagttgcgcactactgctcactcatcatcggtctcaactcataaatccgtttaagagtggacaggatgacacttgaggccatctactgagtcctaattaaaaggaagagtcgttctgtgtattttaaattacaggacaatttcaggagctgatttcaaaaatcatctcatctagtctatcccaagcaatcatgaccatatgagcagaatgttttgttagcagtgtaagatgaaagtatttaaaggagatacatcctataacaagtaacatacccagaatagatatattcaacaaagcgacggctaagattattcttcaatgacaactctaattaatttgaaaacaaatgtagtgtccacgtgtgtgctttaaccacatttttataacctatagtatttgatcaacctattccttctgtaatattacctaccttgccacaaactccttattcttatgaccagtagaagtatccttgaaggaatagctttcgctgcttatgatgaagggataaacaatagcctgcgggtagttatcagtgatttcttccacagagtgctgaacagcaacggcttggtctttgtccagtaaggccaccatgtggctgatccagctgatgaactgccagcagggaacggaagagatctaaaacagagagctgaaacttaatgctgagtaaaacatctcacatcatctgttataaaagtaacatatgtccaaaataaagaaaactcagaagtataaaaacgcaagtacaaaacaagtcttccatcccctagctctcttctgctgcggcaaccactggactctcccaggcactttctgtgcaggagaacagtcttttgttgcaagaatggaatcacacgagacagctgctgctggttgttcttagacagatgtatagaaaaatcttctacttcattcctcctggcggctatgtagtattccatgttgtttactgctctataatgaatatttcaattttttatcacaggtaatgctgcagtagacatccctgtacacataactttatttatttatttatttttttgagatggggtctcgctctgtcgccaggctggagtgcagtggcatgatcttggctcactgcaacctccgcctcctgggtttaagcaatcttcctgcctcagacttctgagtagctgggactacaggtgcgccaccatgcccagctaattttcgtatttttagtagagatgggggtttcaccatgttggccaggatggtctcaatctcttgacctcgtgacctgcccacatcggcctcccaaagtgctgggactataggcgtgagccaccgtgcctggccaactcttttttttttttttttcttgagacagagtctcattgtcacccaggctggagtgcagtggtgtgatctcggctcactgcaagctccgcctcccaggtttacgccattctcctacttcagcctcccgagtagctgggactacaggcgcctgccaccacgcctggctaattttttgtatttttagtagagatggggtttcaccatgtaagccaggatggtctcaatctcgtgacctcgtgatcggcccacctcgacctcccaaagggctgggattacaggcgtgagccaccgcacccggcctttttttttttttttttcttttgagatggagtctcactgtatcgctcaggctggagtgctgtggcgtgatctcagctcactgcaacctttgctttctgggttttagcaattctttctacctcagccttccgagtagctgggattacaaacactcgtcaccatacccagctaatttttgtacttttagtagagacaagtttcgccacgttggccagactggtcttgaactcctgacctcaggtgatccacccgcttcggcctcccaaagtgctgggattacaggcatgagccaccgcgcctggtcccctgtacacgtaactctttgtgctatatacctgtaggataaattcctagaactaaaattacagtgtcaactttaaaaattgtaataaacattggtatggaatttttttttttttttatgagacaagagtctcactgtgtcgcccaggctggagtgcagtggcgccatctcggctcactgcaacctccgcctcctgggttcaagtgattctcctgcctcagcctcccgagtagctgggactacaggcatgtgccatcatgcccagctaatttttgtatttttagtagagacagggttccactgtgttagccaggatggtctcaatctcctgacctcatgatccgcccacctcggcctcccaaagtgctgggattacaggcatgagccacggtaaagaatttttcaaattttcatttctgaaagtattagactgactactttctaaagtctttaccaacactgcacataatcatcttttaaaatcactgtcgagccgagatcacgccactgcactccagcctgggtgacagcgagactccgtcaccaaaaaaataaaaaataaataaataaataaaaataaaatcactgtcaatctgagaagtgaaaaacacctaatttaaattttcaacttacattattagtgaggctgtatgttccatgtttatttgccttacatcctttaatcacgcatgcatttcctcccaccattttctactggtctattgtgaccatttattttgtagattgccgaagtcagctttttgtttcttatatgtgttgcaaacgtttttcttcatttttttttttgttgttgttgttttttttgagacagagtcttgctctgtcgtctaggctagagtgcagtggcgccacctcggctcactgcaacctccacctcctgggttcaagtgattttcctgcctcagcctcccgagtagctgggtttacaggtgctcgccaccacgcccggctaatttttgtttctttagtagggtttcaccgtgttggccaggctggtctcgaactgctgacctcgtgatctgcccaccttggcctcccaaagtggtgagattacaggcgtgagccactgcacctggctttttatttttttaactttgtatacggtattttctttttctgtatagaagtcaaactattttccttcatggattctggtttttgtctcttcattccaagaccatttaaaaaaatgtgttcacattttcctctgatacttttaaggtgtctttctgaagataaaacctgatgtgtctgcaatgctagagtgaggcttgagtatgggcaagcttcctgagtgcacgtgtgagctgaggacagcatggcgtgtgaggaaggatcagtccacacagctcatgtaagctcacgagagaggctactggcttcactgcacgtgtctactgggtgttttgacaacgtggagtgaatacttcatgtcctcacaaattcaaatgctgtttttatcatgtataaatattatattggaaaaaaataaaatcataatgaagttatttgctcacttatcttgaagaaaaacacatacatgttgcacttctgaatttaccttaacctgtttaatacctactgagaaagtctactattcagaatgcagaaaaaggtggaaggagtggttagggccctaaaagtcaaactgggtccccgcagcccagagatcaacattatttaaaaactcaccatgcaaagctaatagagaacgaaccatgtaaccctttttgaactattacattttcaactcaaagcttggccctatcttccagttacacgtctataaatgtcaactacgaagcctttcagaggccctacactttgcaaatgaagtcagtggaaccctcctgcacacagacagagcccaaaggacaggagtgcagctggcagtgcagcccttggtggggccaaggggcaggtcacatggaagggtgcgggttcctcccatgtccatacgctgacccctcactcatgctcccagacccctctggacaccgtgctgctggcagatgctgtgctcctgggaggtgggatgcaagctgaaccttgctcactccctttgggctaaatgacaggtgagcactgggcacagcaaatgtgactggccacagcctcatctgcaggggcaacaagtttcccacacaagatcccgttaccatcccacacaccccgtctccatctctctggatccttgttcagacacagtgtttttatcaacacccacagaggaaaatgggtaaatgcgaaaactcgtttttgcagctttaaattacctatgtcctcagaatgtagcagaattcacagctggctgggaaaagctataatacatgcactgcacacactaacgcgtttgaatataaataagcgtatctttaagttctgtaaagttccttaccgccaagtagaataaagacaccaacctcttttgtcatgaggctcaaagtctcctctggataccgttctataatctgaagtaatctaggaaacttcaatctggcttcattggaatttaattttaaagctttcaacattttctccaccacaagtgctggatacgcctgcagttctgcagaatcaataactatcaaggacaccaaagaagaaagcaatggtcaatgtatcccaatatccataaactatgatgttaaatgctaacactttccctttttggcttgtattttgtagtgtcattgttctcttcttaactaccactttacaccaacaaacaccaggtacagttttgtatctatcctggagccaaatccttccattagagtgcccattctgcatgaagcacagtttgaatcctgggctgggaacataaggggcaactggtggttattgaatttattccaggagcatgaagcaggccacacgagccagtaatattgaagctgcaagcaaaatatcaaagtagaaattaaacaaatggaaacagaggaccacttgactccatttaaatgtaggtcatgttgcttagagaggccattgtctctctcttttttttttttgagatggagtctcgctctgtcacccaggctggtgtgcagtagtggatatcggctcactgcaacctctgcctcctgggttcaagcaattctcctgccccagcctcctgagtagctgggactacaggcatgggccaccacgcccagctaatttttttgtattcttagtagagttggggtttcaccacgttggccaggctggtcttgaactcctggcctcaagtgatccactgcacccggctgccattgtctcttaaaaagacagtaggattttcaaaatatttgtaatttgaaaacaaacaaagaggagaccaaaggtatgtacaaaattcataagactttatgctgacataatggaacactagctttttaattttcaattcacctgatgcattctcttcctccttgcgcagctgttggtcacagaaatctgccagcgtcatgtaagcatcaatcaccccagctgcaggcccacagctccaggagggaggctgggcctcctcctcagccgcctgcacagcctcagagaggtgctggaatgctctctggtacagacccgcgatcacctggaattcacagagacctaaacccatgagcatgactgaagctttctcaaagaactctgctttccatttgtgactcatgacacataaatggatcaacagctccaaaataacactgaagctatggaactggaaaaacaagagtccaccctggctgtgaaggagcaagcaattccagcaagatcctcagcaggtaacaactggccaaacaaaaatgcaagcccagcgcgggccagatggtgcacaagcaacacagagctgggtctggtcagtggagtgcgtggctgtcgggaatataagagggagatggaagtcggctcctgcactcagtgtcctgcacagatgctagtagcatcatggaaggagaagacaaggccccacaactgaggtgaggcaggacatagtgaatgagacggaagcaggtaactattgaaaaaaacaaaataatcggcaagaagctaagcaaagcaggcactaaataaaaatgcagaaaaggctgatttgttccataagctggtgggacgtctgaatggtgatgggtggggaaatttaattaacaaaagtcataaaagaacggtctacagttcttttaattcaaaaaaatttaaaattcatgatttttaatattaaaaaatttgtgtcattcaaataaataggaagcacggagtatgtcaattttccacataagaaaattggctgtgcgtgccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaatcaaacaccacatgttctcactcataggtgggaactgaacaatgagaacacatggacacaggaaggggaacatcatactctggggactgttgtggggtggggggaagggggagggatagcattaggagatatacctaatgctaaatgatgagttaatgggtgcagcacaccagcatggcacatgtatacatatgtaactaacctgcacattgtgcacatgtaccctaaaacttaaagtataataataatttagaaaataaataaataaaaacaaatacataaataaaaagaaaattggctgtgcataactgtcaaatatattttaaaaacacaaagcaacatccttattattactttcctgtagcctgaacactgcacattgaagacatacacagcacactagcgtaaaacattcctccagtattaccttctctgaatcctctgaactggatccagaaagctctaagattcttctagccttgtcctcctcgatttcagcaaggcaggctggctcactgctgagagcattcgctatgatcctgtaagttgtacccaagagaatgttctggtcacggaaagccagaatatttttgcttaagtagcttgacacgttgttctcatctgttggattaaaaaaacaaaacaaaacaaaattttgtatgtgtgtgtggaattaaaaagaagaaattcattgtctatagaagttttcttttcttttgtttttgggatagggtctcgctctgttacccaggctggagtgcaacgacacgattttggctcactgcaacccctgcctaccaggctcaagcgatcctcccacctcaacctcccaattagctgggactacaggcttgcaccaccatgcccggctattttttgtatttttggtagagatggggtttcgccatgttgcccacgctggtctcgaactcctgagctctagcaatctgcccaccttggcctcccaaagcactgagattacaagtgtgagccaacatgcttggcctaaaagttgttttctattaagaaattaataaaaataaatgttgaaagtataagaaactgacttcaaatactgactagggaatttcttgaactcacatattaatgaaaaatgttctttgttagaagtaactgtatcaaagcccacagaggctaagcaattgaaactttatgaattaactttttattcaagcatcatcattctgcaatttttcaaagcacctaattctgttataaaaaataggaaatgggtactaatgtgtttgtacatatattaataatccagagtagatctttaaattggcactgtggcccatagctaatgaagcaacaggcactgctacatttaaagttctagttctgctttgactgtgtggttctgggcaagtaactgaaccagcgctggctaagtctgcagtgtccagaggtgcgataacagtgttgaaactaggaggcctgatcaaccacatgccctccttgcccatgatgtgacagttctctgccaaagttatctcacatacaggatcacaactactggccctgcttatcatgcaaggctgttatgaactacaaccatactctgtgtaattattattatatgggtatatggatactaatattaacatcagcaaactcctcctcttcccctcaaaaaagcccatataattatttagcaatcataaggataattttcttcttcttcttctttttttagaaacagggtctcactacactgcccaggccagaatacagtggctactcacacaggcacaatcatggctcactgcagcctcgaactcctgatctcaagccatcctcccgcctcagactccccagtagctgggactatgggtgcgtgccaccacatccaactaggatgatcttctgctcttgggatcagtgtacaaagagtgcttctcctctagacacctttattgaggctgatgcttaagagctggtctgggaaccagctggatcatgcctgatcagaatgctagcacacaccctcagacacagggcaacagagcgggggaccaaacccaaacctgtacaagaaagctttcttcctttaatgtagtcttaaagactaaactattttgggaggaaatggcttttttttttttttttttgagagacggagttttgctgttgtcatccaggctggagtgcagtggcgcgattttggctcgctgcaacctccgcctcccaggttcattctcctgcctcagcctccagagcagcttcgaagacaggcgcctgccaccacgcccggctagtttttgtaatttttttttttctttttgagatggagtctttctctgtcgtccagggtggagtgcagtggcgtgatctcagttcactgcaagctctacctcccgggttcacaccattctcctgcctcagcctcccgagtagctgggactacaggcgcccaccaccatgcctggttaatttttttgtattttcagtggagacggggtttcactgtgttagccaggatggtctcgatctcctgacctcatgatctgcctgcctcagcctcccaaagtgctgggattacaggcgtgagccaccatgcccagcctagtttttgtatttttagtagagatggggtttcatcacgttggccaggatgttctcgatctcctgacctcgtgatccacccacctcggtcgcccaaattgctcggattacaggcgtgagccactgcgcccaggctgaaatggcttttcatgtttgtttacatcttatatgcaaacacaaagttttcaaaataattaaactatcattctctggctcactttgctatattccctgaaattactgcaaagatttacctcccaaatgtcagatgatgcagcacaaagaagaggaagatacacaagacaatataacacagccctttaagatataagtggataaaagcggtcaacttacccaacaaagagactgttttcagcacagtgagcacctgctcagagcagccctgggaccggctccggcagtggctcaggcggcagtagctctgcacccagctcaccagccaatcgtctctggtttttgactctttatgcagctccttcagtagtttcatagcaagtgagaaattgttctgtatgaatacaataaaaagagagaaggtggtatgatgatacacaagtgacagaagtttctaattggcctgcttccccctttgcacgacacaatccaccttagagtagcgaatccatttctttagcttcaattatgtctctaaatttatcactgggatataattcatatttaaagagtacaattcaggccaggtttagtggctcaggcctgtaatcccagcattttggaaggccaaagagggaggattacctgagtctaggaatttgaaaccagactaggcaacatggtaagaccccgtctctaaaaaatttaaaaaattagccagcaccatggcacgtgcctatagtcccagctactctggacactaaggtagtaggatcacttgaacctgggaggttgaggctgcagtgagctgctgtgtactccagcctgggcaacagagcaagtctccaaaaaaaaaaaaaaattccagggggtgtggcagggtgggtacaattcagtattttttagtatatttacaaagctgtacaaccaccacccctaattccagaacattttcactaccccaaaaagaaattcactgtctgttcagagtcactacccagccattggcaacaataaattcccttcctgtctctatggatttgcctacaccagacattctgtaacaatggtatcagaaaataagtggtgattttgtgtctcgcatcttttacttagcatgatgttttctaggttcatgcatgttgcagcacctgtcagcacttctttcctccttatggctgaataatactccattgcacggacatgccacttttttttttttttttttttgagatggagtttcactcttattgcccaggctggagtgcaatggcacaatctcggctcactgcaacctgtgcctcctgggttcaaacaattctcctgcctcagtctcccaagtacctgggattacaagtgtgtgctaccacatctggctaatttttgtatttttagtagagatggagtttcgccatgttggccagactgatctcaaactcctgacgtcaagtgatccacccgccttggcctctcaaagtgctggaattacaggcctgagccactgcacccggctggacatgccacatcttatttgggttgtttccacctttccagctattttgaataatgctcctgtgaacatttgtgtatgaatttccatgtgagcttaagcttttgtttctcatgggtctgggagtggaattgtcgggtcatatggtacctctgttcaactgttttgttttgttttgtttttgaggcaaagttttgctcttgtcaccaggctggagcacagtggcacaatcttggctctctgcaacctccacctcccaggttcaagcgattctcctgcctcagcctcccgagtagctgggattacaggcatgtgccaccacatccggctaatttttgtatttttagtagagacggggtttcaccgtgttggtcaggctggtctcgaacccctgacctcaggtgatccacctgtctcggcctcccaaagtgctgggattacaagcgtgagccatcgcgcccggcctcaacatttttttttttttaagtatagtcaagtgaagcatcagaagtggagaatcaacaaagaaatcttaaatgtttgtgatcaattagttgcaaaaaccactgcacttggactagcctctacgtttaactttttgaggaaatgccagactgttttccacagcagatgcaccattttacattcccaccagcagtgcagaagggttccagtttcccccatcttctccaagctttgttatctgtgtatttgcttccagccatcccagtgggtgtgaagcggtctctccttgtggatttgatttgcatttccctcaagcctagggatactgagcatctttgcatgagctggttggccatttgcctatcttctttggataaatgtctattcaaacacttcatgcccatttcttaattgggttgtttgactctttgttgttcagttgtgaagcattctttatgaattctggatactagacccttatcagatatgtgatcaggaaatagtttctcccattacatgagttgtctttatacattcttcagcttctcaggtaaggcacgacagttttaattctgaatacaattgacccattttttatttagttgcttatatggatgtctttttaaatctacacctctaattctctctcaagcttcaaaagacattttcatcagactttggtcttcctaattactgccatttcaaccgcccaggctagaaatccgagttgtttctagccagacactctcatcactcctgtcacctcaggttctcctggatctccttacagagcacctctcttgccctgctcactcccaccccactcccctagtgtggagcttcctggtctttctctgcctttgctttccccagagctgtcaatctcccacacagcttacaactagccagcatgcatggaaccttcaatggcctcctgatcccggtaaggatgcagtctcccgccctctgcaaacccagtgccatcccatgtccaaatccttccatgcccataaagcctaccctaaatcacatcccccttccccagacacctccctgtccaaggcagaagctcttctcttccctgcgccctccaggctttgctgacatctctcttctttgcccaccagtgctgttgtcatcatgtgtgcagcccccactcttactagacagtaacaatggcagggaacatgtctttcccctcatcatgccagacagtttcctaactacactgggtcctctccccatgaccccaactccctcaccactaagtccttcagttcagatcgccccttctggccacaccctgcttttctctcatccagttcctgctctgcctgcctctaattggattttctgttatttgcaatataaaaattcttacttgatattacactcatccaaagaaaaatctataaatgagcatttaaagctacaaaaaagaagtattatttctactagaatatcatcctttgccttgcaatagcaattgatagagggtcattaacatagcaagcttctgtagtatgtttaaagattatatacatttaaatagattacatgcaatttttaagcaatgtatacttaatatcaagaaggggtcctagtattaaatgataattcctacaaagtaaacctaaaaataatttgtaactaactggtaaggattcattttgttaacgatcaaacttgacattaggtttatctgcttttcaagtaacagctaacaatcattttgaaatgattaacaggaatataataaactctagaggctttctggagagttttgaataagtgctccttcaagtttcctttttctctgagacaggctctcattctgttgcccaagctggtctctaatttctgggctcaagtgatccgcctgccttggcctctcaaaatgctgagattacaggtgtgagccactgcacccggccaagtttacttataaagagagaaaaaaaataacacctaccaattattttaaggttcagactctaaagaaaagctaaaattagagaaaagctaatttagcaaaatcctgtgacacagcagggaggacagacacgagtacccacctgcttccgggcactgtctatcatcttcattttcatggaaaacttgcaactcctgatcagggagctgatatcttcttcctgctcttgcacttccatcctgtcactggggtctccatcttgatccacattcatactattatcttctggaagaggggtaagcttctcctctattttgctgagaaagaaacatctacacaaagaaaaatgagacaatgtcacagactcaggaataggaagctgctggatagcaattacaggcagaaattctaaaccttagtaaatgtttgttcttttttttttgagatggagtctcactctgttgcccaggctggagtgcagtggcaccatctaggctcacggcatgctctgcctcccgggttcacgtcattctcctgcctcagcctcctgagtagctgggactacaggcgcctgccactacacccggctaattttttgtatttttagtagagacggggtttcactgtgttagccaggatggtctcgatctcctgatctcgttatctggccaccttggcctcccaaagtgctaggattacaggcgtgagccaccgcacccggcctacttattttttttttgagatggagtctcattctgtcgcccaggatggagtgcagtggcacgatctcgacttactgcaacctccaccttctgggttcaagcgattctcctgcctcagcctcctgagtagctgggactacaggcgtgcactaccacacccagataatttttgtatttttagtagagacggggtttcaccatgttggccaggctggtcttgaactcctgaccctcaggtgatccttgggtcacctgccttgggctcccaaagtgctgggattacaggagtgagctatcatgtctggcctaaattttatcttttgatgaatgggtaacataccctgtgttgagccattttgctccttatatgtcccaacttaaggtgataaatacataacagtaaacagtttaaaatcactgaaaattttcttttttatttttttgagacagggtcttgctctgttgcccatgttggagtgtagtggtgcaatcacagctcactgcagcctcgacctcctaagctcacacaatcctcttccctcagcctcccaaatagccggggttggttacaggtgcgtgctaccgcatcaagctaagttttacacttttttgtagaaacggaggcttgctatgttgccaggctggtctcgagctcctgggctcaaggaatccttctaaaggctgggattacagatatgagccaccatgcccagccatgaaaatttaaaagagaagtctaggttgctattaaattattattattttagagacaggcctcactatattgcccagcctgtagtgcagtagttattcacagatgtaatcatagcacactacagccttgaattcctgggctcaagcaatcctcctgcctcagcctcccaagaagctgaaacaataggcgtgtgccaccatgcccaacttcaaaattctttttatttgaatcataatttacatgtatgattctgtccaagtaattttatttctattaatattagtaacactgacaaagggccctaatatacaaagctcatccctgatcaaccatcaagtaaatttctgttgtttttccaggaactcatttccaatttcttagaaacagtatggccagggagttcgagaacaccctgggcaacatagtgatacctcatctcgacaaaaaatgtaaaaattagctgggcatggtggcgtgagcctgtattcccagctactcaggaagatcgcctgagctcaggaatttgaggctgcagtgagctatgactgcaccactgcactccagcctgggtggcacagcaagaccctgtgcgtggaaggaaagaaagaaaggaaagaagaaaaggaaaggaaaaagaggaaaaaaggagaggaaaggagaggggaggggagtgcaggggagtagaggggaagggagggtatgggagggagggggaggggaggggagaaggaaacactgcaggaagataaaccatcatgcttcacatctctttttcctttttcctctttttttgttactcccaagatacaacccttgctggccatttcctgttctcaccacactgctctgggctcctcatccccacaccaaccacagtgctggctcattccctaaagctaccactgattttaagctttcactgtttttaatcataaaaataaatacaagtgggtactggattaacatttcaataaataatgaatgactggatccataaatgtctcctaccagtgtgaataaagtgcctgggatctcaggaaagggaggtgggaacgtccacagaatgagacagacttccttgggctgtgaagggtgcatgcaattttaggagtggagttgacaagggagtcccagacagagggaacaaattaaacaaaggcagagaagagttacactgcgtgacatgttctcacatcaaatcagggagaataaaccaagaagagaaccatcttttctaaaaacaagagtctggatccggtatggcactgtgagccccttgtggcctatcctctgctgacaacaactagaaactggataaaatacaactccccaagaactctgagtgaataaaagatggcagactgtatgtatgcgcagggaaatcaaaactgggaaggtctgctattgggatgagcttcctgtttcctctctgtcttactctcttttgcccctgtggagtgtggtggcaatgtgactgagatccttaagacaagcctgctgcattctacccaggggaacaggaaaaggagtccaggcagacaggggctacagggagaatcctggaggggagagaaccagagaaaaatcctctagttctgcacatgaacccaccaggctcaggctgccctgaagtgtgcatgtgcagacagactcaaaacagcacaggtttggacaggaactgaggtttcaaccaacaaaaggaaagacagagcctactatctaaacagatcaccagctacagaattataagccagcatctacacaagagaatccagtagtcccccttatcttacctgcagttttgctttccctggcttcagttactggagatatagtgcaataagatattttgagagagacagaccacactcacataacgtttattatagtatactgtttgaattattctactttattattgttattgctgttactcttactgcctaagagtacaaatttacaaattaagctttatcatatgtgtgtatgtataggtaaaaacagtatacataaggtttggtattatccatggtttcaggattccactggggatctttgaactcctacagataagaagcgactactatattcacaagttacattcaaaaattaactgataaaaagaatcaggagaatgtatccatctcaacagaaaacagatgccaactctatgctgacccatatgctggaatgatcatacaaggaccttaaagcagctatgttaactatgctccaggaggtcaagaaaaacacacatgcaataaatgaaaaggtgcgcatctcagtagaaaaagagaaaatattttttaataaaccaaatggaaagtttacaactggaaaatacaatacctaagataaaacagtcactagacagacttactagaagaacaagtaagacaaaagaaaataacagtaagattgaagacaaatcaatagaaatgatctaatctgatgaataaacaacaaaaaaagacaataaaaatgaacagagtcagggacctatggaacaatgtcaaaaggcacgatgtatgtgtaactgcattcccacaaagagaccaagagaaatttggacaaaaagcatttgaagaaacacaatgactgaaaactccccaaatctggtgacaaaaaggtacagattcaagaaggtaagtgaacttcagatgggataaattcaaagagaaccaggcctagacacatcataatcaaactgctgataaccaatgataaagaaaaaaaatcttgaatgcagccagaaaaatatgacacattacatgtgggccacaacgatgggaataacgaggacattatcttcagagacacagcagccaaaagatactacaaggggcagggagaatctacccagattatacattctgagaaagtgtccttcaggaatgacagagaaataaagatatcttcagagaaggaaaaaactaacaagagttcatcacaagtagacctgcattacaagaactgctaaacgaagatttttaggctaaaggaaaatgacacaagagaaaaacttgggtcttaggaataaatgatgagtacagtgtggtaagtataataaagaacacatacttatgttctaaagaatatgtgaggaaaaccacatatgttctttagaatatgtatgactgttgaaagtacagtgttatctagtggtgttttcattatatgttacttcacagataaacacacatgaaatccatccacacacacatcaacatatcattacttcataatgataaaaggagtattttggcagggcatggtggttcacgcctgtaatcccagcactttggaaggctgaggtgggtggatcacctaaggtcaggagttcgagaccagcctgaccaacatggcgaaaccctgtctctactaaaaaatacaaaattagctgggcgtggtggcacatgcctgtaaacccggctactcgggaggctgaggcaggagaatggcttgaacctgggtgatgcaggttgcagtgagccaagatcatgccactgcactccagcctgggcaactagagcaaaattccatcacaaaaaaaaagtatttccaccgtggcatgtgtatacctatgtaacaaacctgcacattctgcacatgtatcccagaacttaatgtataataaaaataatttcattaggaagacagcagttatccatatgtatgtacctaataacagaatcaaaatacagtacgtaaaaatacacagaagtaaaggcagaaacagacaattctacaatcataggagattttgacatccttttctcagcagtgatggaactacacaaacaagcagtaaagacatggaagatctgaaaagtatccctgactaccttgatctcattgaaatttataaaacctgatacccaggaactgcagaatatacaaaaattttcaagtttacataggtatttactaaaatagaccatatgttggcacataaaagaagtctcaataaaatttaaaaggatcaaaatcatacagagggtgttttctgaccacagtggaatttagaaatcactaagatagccagaaaacccaggtatttggaaattaaaacacttaaatatttaatggatcaagtcacatgagagttagaaaaatacgttgaactgaatgacataccaaaatgtgcagaatgcagctaaagcagtactttacagggacacaaataactttaaatgcttatattaggaggaagaaaaggtataaaatcaacagtttccacctaaagaaactagaaaaagaaaagcaaatataaggtaagaggaaaagaaaaaaatagtaaagacgatactagaaatcaattaaatagaaaacagacaaataataaagaaaattaacaaagtaaaaaactgatcctttgaaaaagcaaaactgacacaaacctttacccagatgaatcaagtgttaaaaaagagaacacaaataaccaatatctggaatgaaaaagggggttccctccacagacactacaaataataaaaaggatgagaataatgtgaacattataccaataatttgatgactttgatgaaatggacaaatttactttaaaaaacaaataaagaaggcagaaatttaaaaagaaaatggacaaagtgattgaaaaatacaatttaacaaaaatgacacaaaaatagaattttatatttatttatttatttatttatttatttatttatttattttgagacagaatcttgctctgtctcccaggctggaatgcaatggcacgatctctgctcactgcaacctccacctcctgggttcaagtgattctcctacctcagcctcctgagtagctgggactacaggtgcccaccaccacattcagctaatttttgtatttttagtagaggcagggcttcaccatattggccaggctggtctccaactcctgacctcaaatgatccacccacctcggcctcctaaagtgctgggattacaggtgtaagccaccatgcccagccagaaatagaaagtttaaattctctatcagtattgactaaggaaattatatacattatcaaaaatcttccccaagggaaaacccatgcccaaataggataggtttcactggtaaatcctatcaaatattcaagtatgaaataatgaggatcttatataatttttttttttcctttggagacggagttttgctcttgttgcccaggctggagtgcaatggtacgatcttgcctcaccgcaacctctgcctcccgggttcaagcgattctcctgcctcagcctccgagtagctaggattacaggcatgtgccaccatgctcggctaattttatatttttagtagagacaggttttgtccatgtttgtcaggctggtcttgaactcctgacctcaggtgatccgcccaccttggcctcccaaagtgctggaattagaggcataagccaccacgcctggccataaactttttttaaaatagagaagggaacatgccttactcatcttatgaggccatgataaccctaataccaaaacctgatgaagatattacaaaaaagaaaattacacaccaatatcccacttggatgtagatgctaaaatccttaagggatcatcatgaccgtattgggtttaccctaagaatgcaagattggcttcatatttaaaaagcatcaaagctaatacttcataaacacaataaaggagaaaaacaatatgattaagctgttgcagaaaaagtgtttgataaaattcgacattcattcatgataaaacaaaactctcagaaaacctggaatagaagggaatttcctcaatctgataaaaggcatttacaaaaaaattattttttaaagctgagtgagtgaactatcttctctaacatcaggaataaaactaagatgctcattttagcacgtatattcaagattgtacttgaggtcctcatggttttaacaaagcaggaaaatgaaataaatggcataaagttcagaaagaaagaaaggtggctctatcggcagatgatatgatagaaaatcccagagaacctgcaaaacaagaactaaaactaccatgttagcaaagatacaaagttaatatataaaaagcaattacattagcagcaaataattggaaaataatacaattttaaaaataaatccatctataacagtgccaaaaaacataaaatacttaggaataaatcacaaaagacatccaagatctccatactgaaaaaatacaaatcactgaaattaaagatatctaaattaacagagatatgccatattaatgaactcgataactctatattgttaagatagcaactccccaaattaaactatagtcaatacagtcccaatcaaaatctcagcagtttttctttatacaaattgacaagcagattctaaaatgtaaatagaaatgcagatcaactaaaataaagtagttttcataaagaaagttgagccaggtgccatggttcatgcctgtaatcccagcacactgggaggctgaggtgggcgtgttgcttgagcccaggagttacataccatcctgggcaacatagtgaaaccctgtctccacaaaaaaagacaaaaaaattagccaggcatggtggcgcacgcctgtggtcccagctacttgagaggctgaagtgggaggactgcttaaacctgggaggctgagactgcaatgagccattatcgggtgacagagtaagaccctgtctcaaaaaaaagaaaagttcgagaactcatcctgtctgacttcaaaacgtactataaagtgatataaatgaaggcagtttgctattgtgaaaaaaacacaaagcaagggctacaatagagcatccagaaatagacccacacatatgtggtcaattgagtttcaaaaaaattgccaaggtgactcaattatgaaagacttttgaacaaatgcggctagatagatatctatatggaaaaagtaaacacctacccctacctcacgccatttacaaaaattttcttccagtgcatcagagacctcaatgtaagacctaaaaccataacatttctaaaagaaaacagtagaagacaggtaagatgagcctgatttgttagcttaaaggggagcctgttggccaaatctgagataattgaacacaaaataaataaggacagtataggttatatcccactaaataaaatttgaatccctgagtctttattgataatctttaaaaagtaaataagtaagtaaacagaaggaagggtgcctgcttacaataagatgtagactaatataaatgaatggtagagttggaaattataattttgcaaccattattgtcaacactggtttgggccaggagtcatccacaaatgtgaaatacagagggataagtcttaggagaagcaggacatttgtatgtctcaaagcagctcctacatttatttgttagttgcaaaagaaaagcaaaaaaatggcattatacagtggagagaccaaacaatcaaaattattatcaccaggctgggcatggtaagtaatgcctgtaatcccattactttgggaggccaaggctcacttgaggatcacttgaggtcaggagttcaagaccagcttggccaacatggtgaaaccccatctctactaaaaatacaaaatttagccgggcatggtagtgcgtgcctgtaatcccagctacttggggggttgaggcaggagaatcgcttgaacctgggaggcggaggttgcagtgagctgagattgtgccaccgcactccagcctgggcaaaaagactgcatcaaaaaaaaaaaaattatcaccagtaaaaggcagatggacactgtgccccacgtgtgatttgctagcctgagaagtattctggccagagacagatcacctgagtcccaccatgaggaaacgtaagacaaacccaaacagaggaacattcctcaaaagtggcagtattaggacacacaaagcctttcaggggactaaaaagacacatcagataaatagagtccatcattctgtactgatcttgttgtagaggtagagaaaatgccacaaaggacattactgggacaattaacaaaactgaaattgggctgtagaggaaaaatgaaagcaccaaggttcatcactgaacagtagttacataaagaaaaattctttttcttaagaaatgaacactgatctataacgaggcaaaggtatgtatccagcttacgctcacaaccggttcagaaaataaataatatgtagggtctggtagaaaagaaaaaaatacaaatactaacatggaaaaatgtttaaaatgttatttaaaaaatcagtgaatctgggttaaagaacccaggagagtactacttttcttgcaacttttccacaagaactcatctcaaaataaaaagtttaaaaaaaaaaaaaaagtagtagtggaggaaataatgggagaccatgacacttggggtcagagtccttaagtcctatttcctacacacatttgtgtgccataaacctctctgattttattacatggttagtacctgccctatggattccacaggttagttacaggatggagaagatgaggacatgaacatgacctgagacctgggaaagtgacacatgactgtgtaatggagttgggaggtaggaggcaagaatgtcaaaaatcctagttataaaaaataggataataaaaatcattatgtagtcgtcttctttgttgtcatctaactacttaacattccgttgtgagagaagcaaatgcacactgaccctgtctcccttcctggaggtgcaggttcaggatcagccaccagcacctcccgacagcagcgtccccacagggcaagcgggaaagaggacactgcagacacggagagctctatcggaactacttacatgggaaacaggaaggatggaaaacagctgtgctaggctcaaatcccacatttctctaaaccatggtttggaagaaaaaccattccaacaatttcaaaaaacaatccacatttgactgaaagggaccacgtcttaccgatttgtgatgatgtcatcccagatgttcattgggtccattttagcatctggatatctgtttgtccaggtgttcagaagtctcttaaggggaacttgagatgataaattgcctaaaaatagtattagagggtgactatacacacagctcaattataagatcaaatgacaaaggtcattatcagtaaatagaaaattcaaacttcctgcccaaattacaaaaaagtcctttcttttacaaaaggaacacaaagttaccatactaaatttaatatattctgacatttaaactcaattgcttaaggacagagaataaagatggagaaataaacatgcacaaattctttttacatttattacaggtctacagtccatctgtaatatcaaaatctaaaaagcactgataactaaaaagattttcatggggttgaagcaaattttcttggcaaaaaaaatctgatcttcattggtatagggctacttagtctttgtttatggcatcaatgtgaatattcataacttaagctgtagagttacagaatactgccctagcccctggcatgtacacaggtaatatttctagtgtccaaaacattctggcctcaaaggtctcagcaaagagattcataataatcttcacaaaactgaaaattcacattgttaatgtgtttttctttctgttgggggaaaacagcagtcaggaacacaagattagatgagacagtcctgggttcaaaattaaaatctttcacttattagcttaggcaagtcattcaatctctataagcctctaaaaaatgaggagaaaaaaatccatctcataaagttgttataaagactaggtaatattggccaggcacggtggctcatgcctgtaccccagcactttgggaggccgaggcgggcggatcacgaggtcaggagatcgagaccatcctggctaacatggtgaaaccccatctctactaaaaatacaaaaaattagccaggcatggtggcgggagcctatagtcccagctacttgggaggctgaggcaggagaatggcatgaacccgggaggcagagcttgcagtgagccgagatcccgccactgcactccagcctgcgaaacagagtgagactccgtctcaaaaaaaaaaaaaaaaaaaaaaaagactaggtaatattgataaagagattaacatagctcctgaaagtagaatgcacttaataaatgatacgtcattaatatgattaatatgtacttgaaaaataattttccaaaattaaaatagaaaataactaggtagacataaatatcagtttttatcagtattctgaaagcatcttttgtaattaattttaattatttaggacaaaaatgaaattcagattaacaaacaaaacattttacctttgcaaagatgtactcttccccttagactcttgggtggcctcccataggcactgggataaaacccactcatcagcgatacaaaggccttcctgatgtgggccctgctgcccgcagccttcctgccctcccttcaagccagggcacccagagccctcagcgtgcacctcaggggcaccacagctttccgtctgcaagcccctgcctcttccccactgctcaggaccctcctccaggagtcctgcaccctctcaggccagggtgggccccaccatccttgtgggcaggtatcctctggagtcaccccgctactccaaaagcttcattaaggtaagcaacatgttttctttcactttgcagccctgatgcctagaactctgcctgaccattttaaacatttatttcaatgatctgaaaataggtatttgtagaggaaattcgatggagtttccaacccatacattaagaaacatgcactttcactaagcagaaaataatttagatgctaaaactcttccacaattagaaatgaaaaaaaaagaccgatgaaaaaaattaccttgtttgcttataaagctgatgaactcctgaatttctgttaaagcctgtacagactgcaatttggtgagtctactttggtgtaagaggacatcaatactagaataattcttaaaaaaaaaaaaaaaaaaaaagggcatttacaaatgccatgttataaatcaatcaagctgtgactttaagtttttaacagtactctaaattatgaaatgtagcaattattctataaatatgcctcagaatggttaataattagatcacagacagttaacaaatagtttaaattttaaaaaaaaatttaaggtttcaataacattttggctcaatgaaatcaataaaactgacatcaccaggctatcactgcctcgacttgccaccaagttttaacaatcctaacatcctataatgtaaaactgctgactacagaagccaattctttttttgataaacttcctcaagagtgctaatcaacttcaacacattaaataaaaatgaaaacaatgaatgaatatgcttctatgctaaatgtcactaacctatactaaatgttattaataaactttatacaagacattcacttacaaacaaacaactgtcaggaaaagattcgcagaaaagcaaaaaggaaagaaagagtggcagcaaacaatcaggaaagatcaacccctgctcttctctacaaagcaaccaaacttccattccgctaccccaaatagaaaagtctactcttggtcaggagcgttggctcacgtctgtaatcccagcactttgggagactgaggcaggtgaatcacctgacgtcaggagttcaagaccagcctggccaacatggttaaacctcgtctctactaaaaatactaaaattagccgagggcctgtaatcccagctacccgggaggctgaggcaggagaatcacttgaaccagattgcgccattgcactccactgtctaggcgacaaaagagaaacttggtctcaaaaaacaaacaaacaaacaaaaaaacaccctactctcaagtgttctttaagagtatgagaaaggtaacaaaaaggaaaaaaaatgaaacctttctaaaatagaaaaaaaagatttaaaaaggcattaagataaaggacagaatgaacagcattattggaagaacagaaagaaggaaataggtggtatgaaaatagtacttgaaaatttttgttgatttttttcatgagtttactgagttttaaaaatatcctaaaaatagtatatttcagatagatccacattataatatatatatacactatatatatacaagcatatatatataatatatagtattacctgcataaaactctgaatgccattttgaatgtaatatttggctctgtcaacatcatcttgcaggaggtaaagcagactcagctcttgactgtaatgaagctctagaatcgccttctggagctccccgtgcatagctttgtcaataaatgtcagcagggactggtcagcctctccctggagcagcagcttcagcttgctgcggatcatgtaaggtagatatgtttcctaaggaacataaaaatatacttgtaactacagaaggccaatttgagtatgtctaattattttatttctattatattctttgctatactttcacaggtcaagatttaaagtcaaagcgatgatgtttgatgtctgaaacagtaaacctccaatttttaaaacaaattcatctaaaatagcttgttttgtaaccacaaaatatataggaacacgttctacaaaaaatgggaactacttttggctggaagatgatttggatgttacgtacaaactgaggaatttacaagcacagtcaggataggtatggtgtggagaaaagcggagagcctcttgtcacaggagctgggaggcctgtgtttagccagtgatccggggcgacttcttgtaatataagagacaacaggaaatatgctcctatgtagtcatactaggaatgttaatatttattttaaaatgcattgcattcactttgaaaagatgattagctaaaagtgataagagatttaacaatactatggggtttgtaggtggactcaggtcatgcaattccctagtgcttcacaagtactacctgtttttgaaatgttttaaacaattttgttaagtagaaaacacctatctaaaataattatttcaatcacttaaaataattttacccacctgataaaatggttcactccagattttatttaggtctggggggttctcactgtctatactggctgtagaacagtattcaagtgatttccactcagcaaggtggttgtaacagtcaagggatgcaagttcccaaaaatccttctcggcttctgtgggctcaccatctacccagtcttgtttattgagagcctagtggagaaaagttaataaaattattttacaaagttggaaagaataccaatgagaacacgtaaaaaggaggaatgtaacaatcacactaaaaacaatccttttcagatttacggaaaggagagagaaaagagaagctattcagagtaacactgaatggaagaaaaaccaaaaggaatcctacagtactaaatgaatagaaaaacccagctgggcacgctggctcacgcctgtgatcccaccactgtgggaggctaacgcacatggatcacctgagcccaggagtttgagactagcctaggcaacatggcctacaaaaaacgcaaaaactctctacaaaaaacacaaaaactagctaggtacgatggcaagcacctgcagtcccagctacttgggaggctgaggtgagaagatcacttgggcccaggaggttgaggctgcagtaagctgagattgtgtcactgcactgcagcctgggtgaccctgttttaagagagaaaaaaaaaaaaaagccacaaaaatcctaactaggaggaagccatttctctgagaaacttaccaatgaaaccaattactaagactgaagactttcaatcacaataacttgatttacatctctactgggggttatttaccacgtaacaagttcttagaataaaattagaatacaggacatttgtagaaaattgcagaggattttaaaacctgggctgctcggctgggagcggtggctcaagcctgtaatcccagcactttgggaggccgaggcgggcggatcacaaggtcaggagatcgagaccatcctggctaacacggtgaaaccccatctctactaaaaatacaaaaaattagccgggcgtggtggcgggcacctgtagtcccagctactcgggaggctgaggcaggagaatggcgtgaacccggaaggcagagcttgcagtgagcccagattgcgccactgcactccagcgtgggcgacagagtgagactctcaaaaacaaacaaacaaacaaaacctggactgctcattgaagagtctcacaggtcacagaccctgaatttcaacacctacacttgaatagccactgacggaatgtacaaaactgaacttatattcatcttcccaaattcttctttacctctgatgtaatttgaatatgtgtccccacctaaacctcatgttgaaatgtaatcctcaatgtcagaggtggggcctggtgagaggtgtttggatcaatggggggcagatccctcatgaatgaagtgggccattcccttggtgatgagtgatcctagcactttgggaggcccaggcatgatggcttgagctcaggagttcccaaccagcctgggcaacatagtgacacctcatctctacaaaaaaatttcaaaaattagccaggcatgttggtgcatgcctgaagtcccagctactcaggtggctgaggtgggaggaccgccggagcctgggagccatgatagtgccactgcactccagcctgggtgacagaatgagactctgcctctaaataaataaaagtatatggcaccccctccccaactgtctctcttttgctactgcctttcaccatgtgaaatgcctactcctgcttcgccttctaccaatgcataaaagcttcccaaggcctcccctgaagccaagcagaaggcagcaccatacttcctgtgcagcccgtggaaccgtgaaccaattaaacctcttttctttataaattgcccagtgtcaggtatttctctacagaaatgcaagaacagcctaatacaatttctttataatttttttttttaactaactgaaagaaaacaacctattcaaacagaaactgtgtaagagcagagaaataatatacagtttcatagtatggtaggccctaacttaagtgaacaacctataaggaaaccaattttcttcctcatcaacattgtaacgaaaagacattgaaccaacaaggatctgctgtacctcgttttgcttaaagtcatagttcagcagaaaacaaaagtgttgaagtaaatgtcatattttgccagagatcaattttacctcatcatactgcttagcagcttcagaataatcacttctggcttctgctaataatgcactctgagtgatttgctttgttcctatctcactggtaaaaatcccacggaggacgtcgtattctccaattgatctatacagcctacaaaacaaatcaaaaaggccaaatcaatgaacactccagtattttaaaagtatttattctaatgaaatgatagtaaatcaagttgccacacattatattaacaagagacataaagtgttactttaattttgctaaaaatataaaatttaagaaactatgaagttgcccttaggttttataactttaatcatacataagccagaaattattcagatgtgcatttaaagtggaatctgggacgggcgtggcggctcacctgaggtcaggagttcagatcagcctggccaacatggtgaaaccccgtctctactaaaaatacaaaaaattagctgggcatggtggcgcatgcctgtagtcccagctacttgggaggctgaggcagagaactgcttgaacccaggaggtggaggttgcagtgaaccaatcaccctactgcactccagcctgggcaacagcaagactccgcctcaaaaaaaaaaaaaaaaaaaaaaaaaggtggaatctgaaaatatcaaaggttcacagtgtataagatgtgtcattacataaggttctccagtattaatccattataatatctacaggcgaaccatttggaatccttgtctagctccaaaaaacccagaagcaaaagaaaaaataatcctgactactgatgccatgtttaatccatgttctatggaccatctcaatttgttggagcattcattcatctctttaccttaacaaaattctggcttgaccctttcaatcaagcttcccagtccatgatattctcaaagtgtttatggggtttgttcccttcctccaggaaatttctttccatcttgcagtctcaacccaaatgttatttcttcctaaaccagccagccaaggactgctccctccttagttctcctgctgttcagttcccttctgggtactaagcctcttgcatttacatcaaaagagccctacaggttctctcctagagcttatgaattctgaattcaataaaatctagtagatgcagctctcttattgccctgattacagaatgttaggggtaataaatcagcagtaaaggtgggtgggtaggtaggtgatggagcagcagctcatggccccagagtcagggaagagggagagctacattctgcatagactcaggaaagagatcacctacatacccctatactggttccattgtccctggattatgttcactataacatggttagaacaatggccatgacatatcaaaaaaaaggctaaggccgggtgtggtggctcatggctgcaatcccagcactttgggaggccggggcgggcggatcctggctaacacggtgaaaccccatctctactaaaaatacaaaaattagctgggcgtggtggcaggtgcctgtaatcccagctacttgggaggctgaggcaggagaatcgcttgaacccgggaggtggaggttgcagtgagccaagattgtgccactgcactccaactggcgacagagcaagactgtctcaaaaaaaaaaaaaaaaaaaaaaaaaaaaagctaaactatgttcacaatgctctgcaaggaatgcaaaaatatcacaaaagtatgagaatgtacttaatacagttagaaaaaaatgtttaaagtttaggcccttaaaagttgtttgcttcacttacttagcaaatacacattatgtatgtttaccactcctggaaatagtaaacatacaaggtgtcacttcctgttcacttacacatctgaagcaacaggagaaaacggttcctaggtaaaatcagcatagctcagaggccctctctgaatggccctggcattttatcttgtctctctcagtgctcaccacctcctacttcaattatgatttatttatgtgtaaagtacatacatttcctactagattgctagttttgtgagtctgtgatcaatgtctaatccaatttcatgtctctttggtgcctggcacagcacttgtacactcagtgctcaatcaggacagacatgaattaactacaaaacagcacgaagcacaaggatcccctcccttacttttactatcttttctcttaaaacctaaagctctaaaaatctgcactacaaaatgaagttcaagttaaatttcaatcttaacctaacaacctcctcagaattaggctttcatatgatgagatcacagagaagggaagaatcagacataatggaaaatggtataactagaaaatggaatctgtttatcccaaataaactaactgatttaaactctttctaaaatcttgagtcctgctgaaaatactaaatcttcctccattcagtgtagtgaagcaggaaataacataaaatattaggaactatgattcacagctacactttacaagaaactaaacttggtgaataatactgagtccaaaaaatcatatactgaaagaaatcagcaggtttaaataacgttctctttccttgagcaagacattacttgttgtggcaactgttcttgcctttgagaatggtactcagcctgaaagacttttcttttaaatttcacattagtgttactatcaactttattagctcattttctgccaaatgaagccaagtgttttccgtattgctttggtcaaatccagtgtgctcccaagagcacctgacctcacacttacttagcaagctccacccatctgaggacatcaggagggaggcgggccttcccacggactcgcttggcaggcagctcagcaggcagcaggcggagcagagcctcctctagcaggcggatgcccacgggctgctgtaggctggccaggcaaccagcgctaacagccgctgggtcgaggctcagcagggctgcgtgctgacagctaatgtcctgtgaaaccacacatacaaccagctgtttagcttgtggtacttggaccatgtcttcacaaggagtaacatactttactaaacataaaaggtacccatgtgggtagtgatatcaccagaagtttctctgtgtaatgctattaacacattttccaacaatattcaatttgctcaaaggaggaaatgaccttttaattttacgcttccattccagggatcaatttaaagcaagaaaagcacctatcaaaatatgaagatcacacacacacacacacacacacacacacacacacacacacacacacgtaaattagaaaccaataaaaaacggagctaatgtataaagaaatttatactgacagtttctcgttccatcaaaaagaataaaacaaaaaactaagtatttcatttcagaaaagtattaaccaattcgtttgtaaaccaatactaccgataaacaatattgaagaatataaattagtaattacttcagaaaaggtcactagatacaaaaatactaaaatgaatcaaaaagattttctactagggaattttatataatccatactttgaatggcacagaaaacatttcttacatgaaaaataatcttctgacaaacatatttaagtagtaactgaatattaaattagattttctgctcaggctgtgttgccttggaaaggacttctctgaccactgcatctaggcaaacacaccctaccccatcaagaggcacctgcttacctgcttcattactatcttacactgctttaacacttccctattactcaagtactatgacacttaactactacctaatgtccctttctacatctccctgtgggttgcctattacccatctattaatgggaatgtaaggtcgggaggaaaggaatttttgcctcttcatcaatgtggcccagccacctagaataaagccaggcgggtactcagtcaacatcttttgacagtagtcaggaagcagaaagaatttggtgaaatactacataaggaaagacaactaaataaatgaagggtttcatcaaaaacactgaagggactggcttattacaaaataaaacgtaacatgtttgatttctggttattctgtcacatatcggtttttctggggggaaaaaataaattacatctactcatttgggaagtggtaacccaaatagtacatcttactctgttaaacaccaggttatcaagagtctcaacacgggaaacatagtgatgatggaaaggccatgtgaagccacagcaaacaatgtatatttgatgaagtgtgtgcagactttacctgaatacaagagacaaagggtggaaagaaagagaaggtggtattaagaaaacgattgaagtcttgaagcaacttttgagtgatgttgtttttttcagacagtgtcttaaatttatccatctctttcaaaattccagaaaacaagctgctaaagagctgttttgcaattattgggtccctctgtaaaaaattcaaaacaaagacaaattaggatctgaagcaaaaatgctataaatcaccaatactatcagagcttggaaaatacaaactgttgcaaacacatctattatacctctcaattctatttggaaagacttagcaggcattgacaaggggagcatttggaatttaaccaaatgtatctgtttgatgtatgttatggaaacatggacttttggcccagagagatacatttaaaagctggcttaatcaatacataatgacatagcttctctcctgagttaagtctgggtctccaatctttaaatgggggctaccagaacacatcacattgggctgcggggaagattagcccagataaagtgcagccagtgcttagtgcagcacttcataaaatctcagagaaagattaaatgtttaggtatttttctcctatcagcaccatggtaaagcttaaaataactgatgagcttaaataaaatgccagtgttaattttcaaggtcccaccacctgaccactttaaactattgaaaccatcaaaggcttcttctgagcatcagctcccgcaaatagcacactacctaatcatttacagccctaaccctcgcacacttcatggccacagtatactccctttatttattcatgctgtgacatcagcgccaacaacagttcctggcatatagtgtctatttttgctaaatggaggcatgaaagcatgataaataaagtttaaaaattactttgtgtaatcttctagggatcttccctgttaataagttttctatcatattataattgacaggtcaattctgttaatatctttttgttaattttgctacacgtttgcctctgaaggaggtgagacttgtgctgctttttgggatcatgttcttttttcatgtctaagacctattttaattatgtttacaatataatgataatccatttttgatgttttatgaacaaattacattattaaatgaatgttcttaaatcaagtgtgatttttgcatattgttgaaaagaacattaaaagcaatggtttacacttaagttactatagccaaaaattaaatacttgaaaagtttactgtgaaattctactgatttaagattatacttaatatttaaaaaataaatctaatcatcaaatgcaaaaaattactttgataaaagctatgtatgactaaaacatacaaatttgatttattccttattgtttattttaagtaatatatttatcttgttataagaagttctagtgattactatataaaattttagaaaatatggctaaatcaaaagcacaatcccgtttacaacagccacagaaagaataaaatacctaggaatacacttaaccaagaaggtgaaagatctttacaaggagaactaaaaaacactgccgaaagaaatcataaaagaatgacacaaataaagggaaacacattccatattcacggattagaagcatcaatatcgttaaaatggccattctgctcaaggcaatctacagaatcaatgctaattctatcaaactaccaacatcatttatcacagaactagaaaaaactattctaaaattcatatggaaccaaaaaagagcccgtatagccaaagcaatcctaagcaaaaagaacaaaactagaagcaccgcactacccaacttcaaacaatactataaggctgcagtaaccaaaaagcatggtactggtacaaaaacagacacacagaccaatggaacagaatagagcacccagaaaatgtggtttaggaaaaaagaaaataagtatcgcccataattataccataaagagataagtcactggcatgtgtcttttactggtgtgtacacttttacacctgtttggtaacctgctgtttttatgtaacacgtggtagacaggtttccatgtctacaatccactgattcctgagtgctaggtacaaattccttcatttatgctccctttgttcagacaaatgcagtggtaatcctgataaataacgataaataacgtcttcagcactgatgatctcagagtctccgcatgtgtaaagaagtcatggaactaggaaatggcagagccaggacttggagcaaggtctttataccaagtccaccgttgaggacaaaccaacacctcatctatgttgcaggacagcctcagccatgtttcctcacataggcaaacccctgaactggaaacagattttaacctgtcaacagaaaacgcagcggcaaaaactgacctgggccacggcctgtaacggggtgatgaggctgctgtgcttgatctgaatgtcaggaaggtctccgtgccggtagcttctgtacagaacgacctgggcatcctgcttcatttttaactcactcttgatttcctataagcaccagaaccaaagaagaagatgagcattctcattgaaggaaactagtcgtgcatgagctatgaggctgccaggatcccctgaaccatgagggcgaagtggtgggaactgatgctcgcagaggctcagtcgccgtactttaccgtctagggcaaacactgcatccaaaataaaatcactacacaacaagcagtggaaaggctttaaacattccctataatcagaatatttataaaatcggaaaatttgatttagaagtatttaaaaaccggctggagagctgcatctctggaaagtctcactgagaacgaggccggcagccggtccccacttccgccccaaggtcctgccctccggctgcctctgctcccaggcagctgcagagcccaaagctcccctccgagggggcaaaacagtgccccgggggcgcagcccgggaggcctcaggctccacaagcatggctgggcggcagggcttggggagggggccggcacagcgccccacttccagggcttcacacccagatgtggatggagccgctcctgtggcggcggcggctggcgctgaactggagcaccgcgagggatttttcttaacgatccgtcctacccccttcttacaaatgcatcctaatgacccatttctaggcggaatggacgccgcggctacggagtctccacgccacgggaaggccctcctggccacctgtcctcggggcaccgtgggtcccagcccccagctgccctcccgccgcattggtccctgaagcgagggccagtgaagtcctgccagggcgcgggccttgaggtaggcctgggatcagccggctgatcccaggccggccacacttccacccgcggagagaactgggcgcactcctggacccccaccagagcgccatgagggctgcatccctgtgggggagccccaggaggctggtttggagcagtcccgcaacctggtttgcaggtgacattggaggcagtgtctggcaggaagcctgttcacttcgtctgtatcctgtgacagaaactgcatcgttctgatcaaattcttgacaagatacaaaccttctctcgtttttgctcagcaacgccttttctggcatacatcaaactgagcttctcctggtccctcataaaccgtctgcgcagtcgtagtaggtccgtccggccggccgcacctggagagggaaagcaggcccagttactccccgccgcccagacacttggctctgctggttcattttcacctcgggtttcctcaaagacaaaacctacaggtgccgcagaggcagcgaccgggagcaggagtgcaggggccacagctgcaactggaactgctcagcagtggattcagcaggcatgagcgctgaacgggccaggcccctccagagggaggcccagggagggcacgcagccaccttctgaacccccgcccaactcgcctggcagtgctttgcctctggctaactgaactagagaggagctgcctcggaggcttcaacacctggtgcagaccagcctccctcgggactgtggcaacctgaccagggacaggtgaccgcaacactcctaacccgtatgattccaaatgcctgtttagtaccccaccaggagacaccagccttaacctccaaatcacgacaggttctaaggaaagtttcaaatatgaacaacacaagccaaagtaagcaacaaggaaagagcaactgttaaaagcagatcatgcaggaaaaaatttcaaaacatgatcatttatcagaaagagaagagtaggaactgaagaaatgttcagagcatgaaaaaaagctcatggaaactgaaacgtgtcataacttaaaagcacaggttgaaagataaggttgaagggatttcccagaaaagaggaaaaggaaaaaatatgacacctcagaaggacactcacgcaggtgagatatctaagcactaggactccaaaaagagaaaacagcaaactgagatgaagaactcaacaaaatcacctgtgatgatgctccagaactggaaggtgagagtcagcggcctggaagctcccgccatatgcccagaaaaacagactgaaacggatctacgcccaaggacacttgtgcgcaatgtcagaacactggtttaaaagagaagatcccgagagcatccacagagaaaagacccacgttctcacaaagcatccccaaggaggatggcaccaggcctggcgcccgcagccctgcaaagcagggagtccaggggccccacgtatggagctccacagcagcactcccgccagaccaccaagccatcagatcccagagaaagctccctgctgctgaccccattctcagcacccaggtggctccacctgaacaaccgccaccagcactccttcaactcacagcacatgccaaaaggtgggccacactgacctctccaggttccatttagagaactgtgtgtgggccacaggtttgtgactgaaaagtatgagagagtggtggagtaaagcaagttttgttgcctgtgtttcagttcctacgattagataagaaggcagggagctttgcttctaagttcttctaagtttacttccacagagctgagcttccctgctggcgctcccccagggttctgtcatgggccctttcctctctgcacatgtccttcctctgggcccttgttccctcccagagcctcacttctttctcacaaaaagctgcttccagcctctcggcacccgtctagttctggtcatctgttagccaagaccaggtcctggtgcctgcctccagtccccatcactccacttctgccccacacaaacctcagagaagggcattcagtccccgtgccttcctctgctcggtgcgttacaaggctgcttcctaaagctgaagttcgacatacacccccacacccacaagactgtcctcacagcaccctttgccgttactctagcatgccccgaagcgtcccttcacctggactgcagaatcgatctgagcctacccaccctgacacttctccatccctgtccttttcatcctttcccttcctgcacccccagctccaaggctcctctcaaatgctcttcctccacccagtctttttggacgctctcctcattctccacctgtattaagccctctagccctagaccatgcttgctaattccacctcttgttacaatcacccctttataaatgcctcacccactcttactgctccagaagatcactcaacaatggatcgagtataacttactgaaggattcttctggaactcccagaaaacaatttcttcagcatggtgagtgcctaggcaacattaactgaattttaaagggcttgattacgaatgagaaggaaacatggatacagtcagaaatgtccccagacctgagctctgcagtaatttagtggggaagctattttaagcacactcagcaacccagcttacctttcactttgttatccacctcgtcccctggaaggcccagcctttttttcccaaaatcaggccccactgacttcaagggtgctctctgtaacctttcactcctcttgtgggcaaacagcaaggagtcagatgagggactggtgtggtcgaccagcgggtcagtgctgctcccggtcagccaatcaaatgagcttcttccatctgtgacatgcaatcagagaggtcaggcactcagcatcacccagctctgtgcacggggcaggaccacctgccaggacacacctggtggcaccctaggcctccgtgctcaactccaaccctgggcagaggctctgtcaggtcccagggtatgccccaaggaaaaccaggtacgtgcgcctcagtgcccctggaccgcagtgtccccatttgtaaagtaagaaacacgccacttgctcccaccacaggaataacactttgttatctactgaaaggtgctaagaacccctgacttttttttttttttttttttttgagacggagtctcgctctgtggcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggccgcccaaagtgctgggattacaggcgtgagccacagcgcccggccccctgacttctaatattagtgtcacagaatttcaattgtgattattcatattagtcccacttccagaaccaacaaaatgtgcaaaaaaattacacaaaggagaaacgttaaagagtttatataaaaggattaagatatgttactctacaatttgtactttgctcatcaaaggaagcagttaaaccatctgagaaagaacagtttaataactataaatctagtaaatgaatttggtttacctctactctgctttggtgataagatgtcttaaatttgctacactatgtttttctgtaccaaaccaaaaccaaaacatacatatactgaaactttccctgatctttctggtcagaaataatccatttcttttttagaaaaattgtagcaaaacaggctgggcgtggtggctcacaaggtcaggatatctagaccatctggccaatgtggtgaaatcccatctctactaaaatacaaaaatttagccaggcgaggtggtgcgcgcctgtagttccagctactcaggaggctgaggcagaggaatcgcttgaacccaggaggcagaggttgcagtgagccaagatcgtgccactcactccagctccagcctggtgacagagcaggactctgtctcaaaaaaaaaaaaaaaaaaaaaaaaaaaaaggaaaatatacataaaatttaccatttcaatcattcttaggtgcacagttcaatggcattaaggacatttacgctgctgtacaaccatcaacatcttccatgtccagagttgctttttggtttttttttttgagacagggccttgctcttttgcccaaggcagggtgcagtggcgtgatcacagatcactgcagccttgaacttctgggctcgagccattccccgcctcagcttcccccgtagctgggactaactacaggcgtgcgccaccatgcccagctaatttgtaaaattgttttgtagagatggagtctttccatgttgcccaggctggtgcggaactcctgggctcaactgatcctcctgccccagctggaataacaggaatgagtcactgcaccctgcctccacagcacttttcctcttgcaaaactgaaattctgtacccattaaactataaatccccattcctcctccccagaccctggcacctggcactctactttctgtttccatgagtttgactgttataggaaccccctcttttgaatgacatcttccttgggttcttaacgctttttgctattatcccttacttctctcacaaaagcccaacactgttgtgacagaagctgcccacagaggtcagggtgctgtatacatggccagcgggcagggtcactgttacctgcagtctgtgtcagtgtgaagtcatgctgctgctgggtggcccttatctgccctgccactggccagcgagctgagagggacccttcctgggtacgggtctggagagtgccctgggaggcctgggtctccacaaacatcggagtgagaacagtacttcggaaacgccaatcagaatcaatggtatattcctgtacataagaaagtttcaaatgaaataaagtttcaaatgaaataatgctccttttttaggaacactgatatatttctatttaaaatctaatggtaccatcagcatatttgtaccataacttcatatgcagctgaagaagaaccttctctaatttaaaagttttaactgatttgccaactagaaaaactagttaactatcgagtgagaaaacccagctttcttaatgtttgcataaaaaggtttgatatcatgctcagcaccacaacccaaatgcaatgagtcaagcgacccagcttgtccacatacacacgtgccactgggacagatcctgagcttgtgagtgggacaggaggggccctaccccaggagctccctgcaacctgcccatcatcccactgtttaggctgctgcgagacaggacaagctcagcatccactgtggattgggaggaatgaggggagggaaagcaatggcgatcctgacaagggaaatctagtggaggccaagagggtgaggccagtggacctccaggtggctgaagcagaggcacgagccttccctttccttttcagaaaggaatgtgtattctgagaaggcaaagagccagtcaaagctattaaaaatgttcatgaacaggaaaagcctataatattcactactatgagagagaagaccacattacctgaaattcgcattctgacagaggatgctcgaacatggggtttggataatctgggctcatgctggtcatttcgagcagaaaatttgttgctaaacttaaaaagtgcacttctatcttaggagaatataaggaatttagtgccagcaaccggtccaaggtatttgaaggtaacctagtttcatggctccagaaatttcgaataattaatctgaaaagcaaagagaaaaaagtatattgcttagacaatggcaaatgggaaagaatgtgctgtacagggtgtcctgtggagaaggcacagctcttcacccacatgaagcttaacagagagggaaaccaccttcaactatatcaaaaatatagtctgagttatgaaacatatccactgaaggaagagaatattacaaaaaatgtagcatattttttatgccacagaggggaggggagaaactgggtgattttattctcttatctctattctctgggaagttttcaacgatgagtacataatattaactatttgaaacaaaaaaaaaaaatttaagaaattacacaaaatccttcactgccttgccaaaacaatccattataaaaattactgccataaaatactcaaaacatatattaattaaataccaaattaggggtcaggtgcagtggctcaggcgtgtaatcccagcactttgggaggctgaggtgggtggatcacctgacttcaggagttcaagaccagcctgaccaacatggtgaaaccccgtctctactaaaaatacaaaaattagctgggcatggtggcacccacctgtagtcccagctactcgggaggctgaggcaggagaatcgcttgaacctaggaggcggaggttgcaatgagctgaaatcatgctactgcactccagcctgggtgacagagtgagactccatctcaaaaaaataaaataaaataaatgtatgtatgtagttggtgcacatacatacatacataccaaattaggtcttataatttatgaatgcatatgaaatccaaatacaattttaagaagctcaatgaatttaaaattatagcagaatggaaaaataagtaatatacagaaacatataaaaagtatatggcttcttatattgaggctgggtgcagtgctcacacttaaaatcccggcactttggcaaaccaagtcaggaggattgaggccaggcattgaagcctaacttgggtaacatagcaagaccctatctttacaaaaaataaaaaatcagccaagcctgttggcgttatgcctgtagtcccagctactcaggaggctgagggaggaggatcatacgaacccaggagtcagaggctacagtgagctacagttacactactgcactccagcctgggtgccagagcaagacctcatctctaaaaaacataataataataaaaagtttacccctcttcttatataatcagtatttggtaagaaacacatataactgacttactcaggacaggcattttagagggtaacaatcatcattcacactttcatatataactaatattacagtttcctctcatttctaaagtttcaaacactttattttcaacattaatacttacagcatgatctcaactatgtgtgttaaatgggaaacagaagaattgtcattacagactttcttttcattttgaaacactttaactcactgccctaccatacagcatttggtccatatgactttttcaagagtgttatttttaagttgtcaggattgtaaagccttactcttcataatgtgctttaaaatactcttttactaaatattgtgaaatgcagaaagcagagaaaatgctaatactgcaaatacatttctaaaactcctgaaaaatactctatgctacctttgaaagcaatacccttaacatttaattgtcccagcccagttattcacgtactgaagtccagggttctcatcgatcaatccttgaatcagcacatcttttgccaacttaaatatttcctgggagtcattatctgtctcactttctggatctctgcttgagaaaacagcaaaatgtcacaacattaatgctctcttctggcccttttgttcaactacagtaacaccatctagaattcaattttaaaaggcttgttttcccattagactttagatctccaaatcacagcttgccccactcatgggtgtgtgcacaagccttgagaacccatccttgctcccagcaggagctgagtggaacaggaggatgggcccacaggaggcccagcggtcctgtgacgctcagctgtggtggtgtggtagtgcccggtggtcctggcagagttcatctccttagtctttgcaagatcttaaaaggacaactatgaaaataggttttataagcacaacaccacactttttcactctgattttttcacacacatatgtgaaatgagtttttaaaaggatacaattagatataccaaaatacatgttttaattattaatcatatggtaaaaaaaaatgtgttattatgttccagattgctaaggggacccaaatgatccctaaaatgttaatgttgcccaggcaacaaggtgaaaccccgtctccacaaaaaataaacaaaattagccaggtatggtggtgcacacccatagacccagctacgcaaaaggctgagatggaaggatcaactgagcccaggaggaggttgagactgcagtgacctgtgtttgtgcccctgtactccagcctcgtcgacagagcaagaccttatctcaaaaaagtaacaaaataaaatagtcaatgtatagcttacctgtaattatcatgaatccacatgagaatattatacatttgttccctacatgttgtagaaggatgggaaacgaattccacaacggggttcagaagttctcggagttctactggttttaactttggcatcatcttataaattatgtccaaacatactttttgtctttcatcatctctatgggagagattttaaaaacacacaaatttagctatttttattattgcactttcaaagtatgacaggcaactttttcttctttgtttcaaaattagttataatagataacgctacacttatataaaacttatattcttaaaatgatcatggactagattatcaaatataagacaaattacttcatgtgctaccctacactggatcctgaaatagaaaaaggatattagaaggaaattggtgaaatggaagtaaagtctagtttggtaaatagtaatgttctaatgttaatttcttacttttgacaaatgtaccaagattatgtaagggggaaagttgggtaaagggtgtatatggaaattatgtgtactatctttcaacttttctgtaaatgcaaaattacttcaatataaaaagtttatttttagaaaaacctaataatggcaaagtattttttaaaaggacttcaagagctacctggcatggtgtatagtgaagtacaatctgagctctaaatgaggcaaatatctatttccttattttgactccttatagcacccagctgaatgcttcatacagtagatactcagtgaatgtaaggatattaggacagtgacatacattttttgttactgacacaatgcatgtttattgctgtgtaaaaatatttacataggagggggacaagatggctgaatagacatagccaggagggcctctcccaccaaaacagagcaaaatgagtaaaccaacatgcttcgaagacatctttggaaagaaagcactgagcatcaatagagaggcaacacagacactgaggctgaagagggaggaagctgggaagcctgcacagtctccgggtgccaggacctggccctaatcaggtcctaaggaaggggtgagtggagtgactatatggggcaatccacgctcgccgtggagctctgggatactagccacaagagatcccacaaccccaaagacatttgaattggtagggaactgtcagagagaaggcacaggcagagcaccagcctatgtggagcccagcaggtctcactcagtgtggagcagctccagcaaatgcaaccccaggcacccatgcccccaggttctcaccttgctctgagtcactctatcccctgctgaatgctgggctgggaaagagcagggctgtccttcctgtgggtctggggagaggctgatctacacgcctatctgtcaacttcccaggcactcccaaccccagctgctcccacaagagcatacacacagcatagcctccattacccagcctgagtgctttgccagtggccttggagcacttcggcaaccccagcacagtgcttgattccaaggggacagaggacaaagctgtgggcctggtctcagccccccagggtctaagcacatcgttcaggaatacagagctgagatctgtggccagaacttaagctctgcttagaacactgagtagagtgagacgtgggtttgtgttccagcatgagtgctgggtaagtccccttccacaaggctggtctgggaagggtgaggcctgtttgccagctttgcatctgcctgagggaccctgtggcctgaaacacctaacagcccagtgatctgggcgcagaaagcatggcataaaactggctggtcaggctagctacaagggcagacaccagcagacttggtcaagggaacgtgaactgggcagtccccacaactgtgtgctgggcaaaaaaccccaggctgtgggcacctcaccagctgcacaaccacgacaacatcaccctgccctgagatcccccacccttgacctactataccaacagaccacccagagacataccccacaaccctctctgactttgccaagcacagaggaccagtgggcctctggaatgctgcaggtctcctggtgacctaaccttcagctcaggctactgctaagggatggggagtgcagcccaccagggccccccttggggttcaggaaatgtgggtatggtgccagtgattggaaggggctcctctaaggcctgggaatgaacttggtgagggggtcatctcccttcccctacccccagcacagagcactgtgctgaacgcactgtaatctaagagtctatctgctagcccttatccttaagcaccatatactggatcatagtctgaattatatcactaaaaaaaattcttctagtatccatcacctgtgaaacccaatgcaggaacctagagagatcctatacaggagagatcctatacagagcctcaggagagcctatacagagcctcagccagctgagaacacccagaaagggagccagttgactatactcagcatacaccacagtcaaaccctcaaggaaaatgatgaataagaaaacaaaaggtcccatccaagcagaagcaactccaaaaagataaaggaacaccagccctctcagatgagaaagaatttgtgcaaacactctggcaattcaaagtatcttctcacctccaaacaactgtcctaacctctcagcaatggtttgcagacagattgaaatggctgaaatgacagaaatagaattcagaatccggatggcgagaaagctcaagatccaggagaaggctgaaattcaatccaagaaatccagtaaaatgattcaagagtcaaaaggcaacatagccattttaagaatgaacaagccaggcgtggtggatcacacctgtaatccccaccactttgggaagctgaggcaggtagattgcttcagttggggagtttgagaccagcctgggcaacatgatgaaaccccatctctgcaaaaatataaatcattagctgggcatggtggtgcatgcctgtggtcccagctcctcaggagactgagatgggaggatcacctgagcttgagaggtcgaggctgcagcagtaagtcacggccacaaccactgcacttcggcctgggttacacagcaagaccctgtcgaaaacaaaacaaaggaaaagaaaagaaaaggaaccaaactgaacttccggttttgaaagattcactacaggaatttcataatacagttggaaacattaacaaaagaatagaccaagctaaggaaagaatctcagagcttgaagaccagtccttcaaatcaacccagtcagaaaaaaataaagaaaaaagaatttttaaataaaatctctaaaaaataatggattatgtaaaaatccattatatgtaaaaagaaccaaacctatgacttattggaattcctgaaagagacaacttggaaaatatatttgaggatatagtccatgaaaatgttccctatctcactagaggtaggtgggcatgcaaattcaagaaattcatagaacccctgtgacatactatacaagaccatccccaagacacatagttatcagattttccaaggtcgatgtgaaagaaaaaattttaaaggcagctagaaataagggtcagctcacatactgagagaaccccatcaggctaccagcgggcctctcagcagaaaccttaaaaaccagaagagactggggcctattttcagcatccttgaagaaaacaaattccaaccaagaatttaatatcctgccaaactaagtttcataaggaaagaaaaaataaagtccttttcagacaaggaaacattaagggaatttgttactattagacctgtcttgtaagaggtccttaagggagtgctaaacatgaaacagaagaacaatacctgctaccacaaaaacatacttaagtacatagcccacagatactataaagcaactacacagttaagtctacaaaacaaccaggtaacaacacgacaacaggatcaaaacctcacatatcaatataaaccttgaatgtaaatggtctaaaggcccctcttaaaagccacgcagtggcaagttggatttaaaaaaataaaactcaactatcttctctcttcaagagacccatctcacatgtaacaacacccacaggctcaaagtaaaaggatggagaaagatctatcacaaaaacagaaaatgaaaaagtgcagcagtcactattcttttatcagataaaataactttaaaccaacaatagttaaaaaggacaaaaaaggacattacataatgccaaagggttcaattcaataagaagacttaactatactacatatataagtacctaactttggagcacccagattcataaaataagttcttttagatctatgaagagacttacacaggcactcaataatagtgggaaactaacactctactgacagtgttagatagatcaggaaggcagaaaactaacaaattctggacttaaactcaacacttgaacaatcggacccaatacatctacagcatactccacctaatataccagaatatacattcttctcatctgcacatggaacatactctaagatcaaccacatgctcagccataaagcaagcctcaataaattaaaaaaaaattcaaaatcataccaagcacacactcagaccacagtacaataaaaatagaaatcaataccaagacctctcaaaaccatacaattacataaaaattaaacaacctactcctaaatgactattgagaaaacaacaaaattaaggcaagaatcaaaaaatttttttcaattaaggaaaacagggacactaaatgcctacatcaaaatgctggaaagacctcaaatcaataatcaaacatcgcatataaactagaaaaataagaacaaaccaagtccgggtgcagaggctgatgcctgtacccactttgggaggttgaggcaggaggatcatttgaggtcaggagtttgagaccagcctgaccaacatagtgaaaccctgtctctacttaaaatacaaaaaaattagccaggcgtggtggtgtgcacctctagtcccagctactcaggaaagaggctgaggcaaaagaatagcttgaacccgggaggtggaggttgcagtgagccgagatcgctaccactgcactccagcctgggcaacacggtgagactccaccttaaaaccaaccaaaacaaaacaaaccaaccctaaagacagcagaagaaaagaaataaccaaaatccagagtggaattgaatgaaattgtgatccaaaaatctacacaaagattcaacaaaaccaaaagttgattatttgaaagaataaacgagatagaccacaagctagatcaatagagggagacagagacagacagacagaagatctaaataagcacaataagaaatgacaaagataacatcatacctgatcccacagcaatacaaaagatcctcagagactattgtgaacactctacgtaagcaaattaggaaacctagaggaaatagatacattcctggaaacatacaacctcccaagattgaaccagaaattaaaaacaaacaaacaaacaaacaaacaaaaacctgaacagaccaatcaggagctcctaaattaaatcaataatgaaaaaaacttaccaagcaaaaaaaaaaaaagcagaaaacaaaaaacccagggcagatggattcacagctgaattctaccagacatacaaagaattggtacgaatcctactgaaactatttcacaaaaccaaggaggaaggactcctccctgactcattctctgaagccagcatcatcctgataccaaaatctggcaggacacaatgaaaaaagaaaacgtcaggccaaatccctgatgaacacagatgaaaaaatcctcaacgaaatactagcaaattgaatccaacaacacaactaaaagtcaatgcgtgacaatcaagtgtgctttattcctagaatgcgaggttggttcaacatacacaaatcaataatgtgattcaccacataaacagaattaaaaacaaaagccatatgatcatttcaataaatggagaaaaagctttcaataaaatccaacattctgggccaggtgcagtggctcacgcctataatcctagcactttgggaagctgagatggatggatcatttgaggtcaggagttcgagaccagcctggtcaacatgataaaaccctgtctctactaaaaatacaaaaattagccaggcatggtggcatgtgcctgtaatcccacttactcaggaggctgaggcaggagaatcgcttaaacctgggaggcagaggttgcagtgagctgaggtcacgccactgcactccagcctgggtaacagagggagactctgcctcaaaaaaaaaaaaaaaagaaaaagaaaaaaatccaacatccttgcatgataaaaaccctcaacaaaccaggcatcaaaggaatattcctcaaaataataacaatcatctatgacaaacccacagcctacatgatactgaatgatggtaaaaactggaagcattccccttgaaaactggaaaagacaaggatgcccactctcatcactcctattcaacacagtactcaaagtcctacacagaacaatcaagcaagagaaagaaataaaacatattcaaataggaaaagaagaaatcaaactattcctcttctctgatggtatgattctatacccagaaaaccctaaagactctgacaaaacgttcctagaactgataaatgacttgagtaaagttctaggatacaaaatcaatgtacaaaaatcagtaacatttctatacaccaataacattacagctgagatccaaatcaagaatgtaagcctatttacaatagcaaagaaaagaataaaacacctaagaatacagctaaccaaggaggtgaaagatctctacaaggaggactataaaacactgctgaaagaaatcagagatgatacaaataaatgaaaaaacggattagaagaatcaatattgttagaatagccattctgcccaaagcaatctacagattcaatgctattcctatcaaactacctatgtcacttttcacagaattggaaaaaactattctaaaattcatatgaaaccaaaaaagagcccgaatagccaaaacaattctaagcaaaaagaacaaagccagaacatcgtattacccaacttcactatactacagggatacaataatcaaaacagcatggtactggtcgggggaaaaaacaaaatacaaaaaaacacagacacacagaccaatagaacagaatggagaacccagaaataaagccgaaccatctgatctttgacaaagtcaacaaaaataagctgtggggaaaagatgcctcattcaataaatggtgctaactggctaaccatatgcaaaagaatgaaactagagccctgcctatcaccacataaaaaaattaagatggattacagacttcaatgtaagacttcaaattacaaaaatactagaagaaaatctaggaaatacccttctcaatatcagccttagcaaagaatttatgactaagttctaaaaagaaactgcaacaaaaacaaaaattgaccagcaggacctagttaaattaaagagattctgtgcagcaagagatactatcaagagggtaaacagacaacctatagaatgggagaaaatattcaaaatagtcacaaactatgcacctaacgaaggtctaatatccagaatccataaaaaacttaattcaacaagtaaaaagtgaccccattaaaaaatgagcaaaagacatggatacttctcaaaagacataaaagcggccaacaaatatatatatatatatatatataaaagtcatcatcacaaatcatcagagaaatgcaaatgagataccatctcacaccagtcagaatggttttcttaaaaagttaaaaatctggcagatattggcaaggctgcagagaaaaaggaacacttatacatggttggtgggaatgtaaattagttcagccactgtggaaagcagtttggagacttctcaaggaagtgagagttgaactatcatttgatccagcaatcccattactgggtatatacgcaaaggaaaataaatctttctaccaaaaagacacatgcacccatatgttcactacagcaccatttacaacagctaagacatggaatcaacccaggtgcccatcaatggtggactggataaagaaaatggtacatatataccatggaatattaggcagccataaaaaagaatgaaatgtcctttgcagcaacatggatgcagctggaggccactgtcctaagtgaactagtacagaaacagaaaagcaaatactgcatgtacttactcatatgtgggagctaaacactgagtacacatagacataaagtcaggaacaacagacactggggaacagaagaaggggaagggaggatatgaggcaagagttgaaaaactaactactaggtactatggtcactacctgagtgacagattcatctgtacaccaaacctcagcattacgcaatataccttcgtaacaaacctgcacttgtacttccttattcaaaaataaaagttgaaaaaaatgaaaaaaaaaaaaaaggtatatggactaatagactaagactggaaaagagtacagggacagggaaataatataatgtaagtgatcagcagctttctcttttaacatatacttttatgttatgttgcaattttgaaaataaatgaacaatttaaacacattaacagaagctctcacctggcaaaataggtacagaactcaaaagcatacattttaaatctgaagagagccaaggtaaccccataggccacctccttcatttatggatgaaaaacacgccctgggatgtggctccccaagatgccaggccaagggagcagagagcaggcccacctcagcagatatcctattcttatggtgccttcaccttttcttcagagattccaacttcacaaatgtgtatatcatggaaacccacaggttcttcttgagttggagacgtcttaataaattaacgctttatgagccagtgggacccaagagcagggctagtgttcactcacctatgtctcatgacttgaacgaagtccttgctctttaactggaagtacagctctgtcattccctccacacgacaaagtaccacctccagacagagtgttttcaacactccatgaaattttggcagcagaaagaacacagcattcatgaacctggcggggaagggaactggtgagaggagggccgaggaccctcctgccccgaaaggatccctggacagcccatacctgtctgcaagaggagggaagctcttggtcactttgttcaagcacacaataaacttgtcctccatagtattctgatgttgcttcaattgtttcgcaaccagttcacacagagactcctccagtatctgaaaaattaagtttattttcaaatacacaaaagtggaaatgtaggttaagcattgaaagcaaagtttatcttgagtatttaagtgagcccaacaaaggtgctcaatgttgtcacctacaaggtagatgatgggacagtaggtgctggggatgtctgctggtctacactgaccatcgcacacccttaggctctggatccttgagttcctacacctcggtgagccagtccacatcactgtgctctgtgctgagcacccaggtgtctggctcgtgtagatgtcagatcaatgaagatcagtgtttcctactgacaccaaaacacttggtaggaccagtaagtcctttgagaagctaagctaaatggctaaatattgtttgagacatattttatggtgttcagatttctgataaaaaatattcacatggactagaattttcaagcaattctattcacacagcagtccccatcactgtactgtctgctcatgtcctgcctcttttcaccaagtgttgctacctgttatatattcatctgtgtaccatctgtctcccctccccaaatgccagctccccaagggcagggacatgacctgtcctgttccctactgcatccctagaaccaggaagtcctcaaatgtcctccacacagagaagtactcagtagagtccactggcaggaagcaacggaaaacactgctgtccttcctggctcacctccttcctcacaaacatcagaaagaggggtaggcaacgtttcaaaggcacacagaccgaacagtttttcaatgcaaactcaacacagactgagcgcctcaaatctgaaaatccagaatcctccaaaatgcaaaacgttttgagcctcagcatgacactcaacaaaacgttcactggagcatttgaattttgaatttttgaattagggatgctcaaacagaaactatcatgaaaatattgcaaaaccagaaaatggaaacactcctggtcccaagcattttggaatagagataccgaatctgtagtatgaggctatttttaaattatcttaaggaaaacccttaacacaaaaccacaaatttcaacggcctgaaccccatatagaatacacatagtattaccctaccaattaatcagatgtctttttattaaaagtatttaatacgacaacacaatgaaatgatcacaatctagcaagtaaagaaagcaagttataaaacagtatgaataacagagaccaagaacagtggagctgtgtgccacaggtgctgagggacattgcgtgggaagagtgcgagcctctcttactgacttctttttattttttttgagatggagtctcactctgtcgcccaggctggagtgcagtggtgtgatctcagctcactccaacctctgcctcccaggttcaagggattctcctgcttcagcctcccgagtagctgggattatgggagtgtgccaccatgcccagctaatttttgtattttttgtggaggcagggtttcactatgttggccaggctggtcttgaactcctgacctcaagtgatctgcctgccttggcctcccaaagtgccgggattataggcatgagccacagcacccggcctcttaccaacttctttatgtttactctgctttccaaatttctacgataaatccgtatcacttttatattcagaaaaaaatacgtaaaacagaagtgttttttattcttaagttgaaatttaagtcatgagagattaaacctggggatctgctgtaacctgctccatttatggtggaaatgaaacatattatgtagatttaaacctcatatttagggatgttagaatcatcttgtaaaaaagttctactgaattttaaaaatctgtttatttacaaaaatagctgataatccctaaaatgaattacaagtaatatttgatcttcccaaaggggtcatcttaattttattttaaatccaaacaaatccatacttggtgacatggacaagggtccaatcacagcactgggcccactggtgcctgctcaggaccacctggcttctcctgagcctctcctcatccagcccaacagtgactatggcctggactctactctgtcctttctttcaggagagtaactgagctggggttgcaaactggagaatcatgaacataaaggcagtctacataaagccatgaggctggacgaggcgggcaggggagcagtgagtgaggccaaagccgagctgtggaggtgttcagggaaatgcagctgacgaaagggagagggggctgccacaggaggaggacgggagccaagagtgtcctcagggtgtgaccagctgggccacccagacaggctctgcagcagcaagatccccagggatccacagagcaccttatcccagtgatgaacctgaaacccaccaccctgcttgggcaacatggcgaaaccttgtttctacaaaaaatacaaaaattagccaagcatggtggcatatgcctgtagtcccagctactcgggaggctaaggtgggaggatggcttgagcccaggagtgcaaggctgcagtgtgctatgattacaccactgcactccagcccaggtgacagagcaagaacccagctctaaaaagactttaaaacaataaagaacatgttacttcttcattcagtcctcttatctgaacagcgcactgcacttaaacgttcagttaggctcatctcacagtcctgtccagtgggcaaggcagcagtactgagagggtcgcctgggagatccctgcccctgttcaacagctacaccaaaaactgcaaggggaggaatggactgggggaggacagcagctatctaccaggacaatttcctccacaaggaaatcctgagaccaagttcatagtaataaaagctggttaaatactctcatcctgattttacattaccaagtcggttgctgatctctccacgttcaccaagtttccaaggtgtttaaaaatcatgtgccctctctaaaaaactgagtattatatttgctatattatagtaagaaacagtaaaattttaataaatgcagatgcccattttgtttctaataccatacaagaaataaacatataagtatcaagggtcataacaaatcaaaacagagtaagaggtatttattgaaaattgtgtagcacactcacgttttttctctccataacatatcgaagtataagtcctagaacttctgctgcagcggcatacacttctttatatcttacaaaggacatattattcaccaaagcctggaagtatctacaataaacacagaaaagacatatgcatcaaataaaccattctgttgttccacaaatataaatgacaattttccttctcatgtcatattgacagcctaagttgaggaaatctaaatatagaatgtgatgcaaattccatgcacaaatgcacacatcagcatgtacgtaagggtgcccgatgtcataaccagaaaagcatagggcagtctgctgtcccatcatgcagaaccgctgcagctggaccatcccacaaggctgaacagacagaaaggtgcagtgacagaaagagctactatccaagatcacgggacactgactccctttcaaaacccacctactatagcaggacaaggacaataaaatgagaaagagcatactcccagtgccgtctgtgtgaggaggcttcccagggagccacccattcactgtcagcactcaggggactctgcaaggttatcccagtgtagaagccaaagccccagccagtgactgtctaaaaggagccgagttcccactgaggctgccgcgaagctggctgcctcagccctgaggtcatgtgtcatctctggcaccagtaactggtccgacggtgctggggggccaacacggaggaccaaacagagagagtgattgggcagggcaggcggaaacccagggagtggccaggaatcaacactgacttcacaaccctcaggagcaggacaaagatgtcctgctccttttatgatgtcccggaaccatctttctgaggcctcttgtcttgacatgtcacacccagctgccctagctcccaggcgggatggtgcagcccagcgtctaccagccctcaccgtcagagagcccagaacaaagccttccgaggggcctgcattacttttggggataaatgttcagaatatcagtttagaaaataagaaatacttaacacctctcaccttccagcatggatatgaaaaaatcacactgttttaaacacctacatttctcatttgccccaaacatttcttccaaaaaaatctaaatccatcttcctaaatttaggcagacaagaatttttttggtatagatgcggtcttgctatgctgtccaggctggtcttgaactcctggactcaagcaatcctcctgccttggcctctcaaacgtgttagaattacaggcatgagccaccgtgcctggcccagaaacatttgtagcatgggtctggtccttaaaattatcaaaactgcaccatactgaagtctgtcaatccagtttgggtagacgtgacctaaaaaataatcaagcaaacacgtactcgctactctggatgccacactgtgggtcatagggaggcaggtcattggccatcacgatgcctagcaattgaatccctactgagttgtctttagaattaggatctttaccggaaaacttttcaaatattaacctgaaacataagcacaaaggagaaaattgagactgttgcataatcaagtaagaagcaggaagacaaatacagaattttatttttttgagacagagtctgactctcgcccaggctggagtgcagtggcgtgactgagacggagtcttggagtctcgctttgtcgcccaggctggagtgcagttggcatgatctcggcttgctgcaagctctgccccctgggttcacgccattctcctgcctcagcctcccaagcagctgggactacagacgcccgccaccacacctggctaattttttgtatttttttagtagagacggggtttcactgtgttagccaggatggtctcgatctcctgacctcgtaatccgcccgcctcggcctcccaaagagccgggattaaggcgtgagccaccgtgcccggccaaatacagaattttctaaagctaatcttcagggtaagaaatgctttttctttatttctgtttcttccccaggtctagctttgactttacagaaatgctttctttttcttttcccatatccaatatccctgcttgctaatacctcctgttcacatccaggttcctccagctttgtaacactggcaattttatcgccctcgtattttaattatttgcctaaattctcccttagttgatagcaaaactttttggaagttttagcttgcctcaggctacaaaaaaaggaattacgcacaaatcctacctacctcccaccaccctctaccccatgggccaacggaaggtagtgcccctccccagcgtggggacatcagaggcaagctgaggcggagggcagggccactggagggtgcgagacacgcatctggtgccacactctggaggctgtggttttattagtaacaataaattattttcttcctcctatcatttcatgtaattaaatttcactgtaatcatcatttacgacacactacattttaacctaaatttctaaacaatactgcaaaaaccagtaaacatacctataagggatggataaacaatccttccagcactcgacaagggtctttataatttcaaggttgtgtctaaacacagctctttttggatgaaagacatgtttcattaggaaattaagcaatcgatttgctaacacttcatctttagggaccccctgaaaaggtacagaaattctgtattaatatgcggcattccattctggaaagcattttttaactcaagttcatttataaaagaaatctggcattttacaggagtccggctcctgttgaaagccctgtgatttttcagaaacaggtaacaacaaaggctgacctggcaagaggaccaggcaccgccggcgctgcaatctcagagttgccgtccagggtgcaggctgctagccaccatgccccatgcatgcacctctgccttcctccctggagcctccatgcctaggactctttatctgaggccctggacaggggtcgcctgcagggcaggggagcagcatgaaggtgctttccccactccgactcagtatccagtgctttctgactcagctcttccctataaaactgcagagcctcctgttcagggcctctcaatggtgagacggcccttgtctgtgctaatccatctggctgctgagcagtgcaccactctaggggcaaacagaacaaggggagtctccctccagtgttagcctctcactcccatgactccagagtgagtaaaagcttcacggcaacctttctggcttgctgttgctttattcagctacctcgagcccggcagttccactctcttgagttcagctgagccactgacagctacatcaatctctttcaacggacccttgttaaactgaacccctcttaattttttcattttattaagcagaaaacaaagtatttcattacactaagacaaagaaatctaaatttggttaactgtgaaacaaatgagataggtacatccagagacaagcgtgtgagaaagctccacgtatttttttgtggtgggggggtggtggtggagctgggggaacgtagtctcactctgtcgcccaggctggagctacagtagtgccatttcagctcaccacaacctccgcctcccgggtttaagcaattctcctgcctcagcctcccgaatagctaggattatagacatgcagcaccatgtccagttaatttttgcatttttttagtacagataaggtttcaccatgttggccaggctggtctcaaactcctgaccttaagtgatctgcctgccttggtctcccaaagtgctgggattacaggtgtgagccatcatgcctagccccgcatgtgtatattatatttaatacagactgttcttaccatctcctcacatgaaaacgtttgtatgctgtcagtgtccacagttttaaatgagtaggcaaagcaccaacacacacacacatgtctacactggtgggtactgcatttgcctcaacataacatggtgttatcatctggcagctactgctttagccctaatcttgccattgctggtattagtcaatactctgggagtagagaagatggcacaaatgccaaaatccagggacttcaaggcaggagtcctcagagcctcccattcagggttggttgaaattcagtttacacatagttttaataaatttgcaatctcatttctaaggcaagtaaaggcagcaaacaaaacaaaacaaacacctgacagcttcataataaaagcaaggtcagacgaattaccaaaggcaaaggaaacaaaacaaaaccaaagcaggctgaggccatttggtttaggagcacaccagcaatgtagcaacaaatgctgaaaaccatagcacagtcagtgagagggacctgaattatgtgtcataggctctataggctattggcaaaggataatatattaacataaaagatgcatcaatccttactgttggagtggccaagcctgtccatgaaagaatagtggccactatctcaaccaccatgtagtgaattccttctcctccattgttttcagaagcagccagctgcagcaaggggctaagccagtgcttcgcgtaagggcgaaagacctacaagaggatgtaaaagtcaaacatcaaagaatggtcttaaattgccaaaatattaatacaagactgtatcttccatcagctaaaattttatactatgactggacctaaagccaaaagcgaggtaagcacgttaaagtgaaggcattagtgtgggccctaatcaaatatgactggtgtccttattaaaagaggaaatcaggacacagagacagatacaagggggaagatgaggtgaagacacagggagaatgcctgtgacacaccacatagtgcttgaggctgccggatgctaggagtagcctggaccaggctctctcatagctctcgaaggaaccaaccctgccagcagcttgatctcaggccacggctgtctgagtccccccagtatggcaccctgagaccatgtgcccagggtgtgaagaatcaagtgagccccgaggaaagaaggtgctgctgcagccctagagcagcctgtcagggatgtcctgacagactcgccatgtctgcagagctgcccagaatgaccttctacggagccaagtggatggtgtcaccccaccacttagtgcccttagtggttccctggtgctcaatgaatgagcccaaccctctgcatagctctggatggcctggcctggctctggtccagaccacactcccacagcccaggcagtcagtgcagacctgcttggctcacccagggaccacccgtgctatgctactccttccctgcctagtgcaaactctcactgcacttcaccacgtctagctcaaaggcctttccaaaatggactccaagatgctcctacctcacgaactcagcaattgcctaagagtccgctgtttttcatatagagttaacaggaatattttctcccccgctccaccccccgcttttttttttcctactataaggaaagaacgttggcagccgtaagaaagcagctacatgtactttatacaaagaccacttctaactcacgagaggtgaatttacatatgttaaaaacgataaaagaatggtgatgaacaagtagataaatattgggtggctaatcagagaacaaaaatgtcatgctctgcccctttatattttccttttttgtgtgtgtttttaagtatattcatagaattgcaattgattcattcatagaattgaataaacagacttacagaatctattcaaagaataaagaaataatcaattacttacctcttctgtattaataacaagcttggctaagaagagacggatatttaatggtactattggatttcccagtttgccatggaggaatttcatccaagaaggaagatctcttggcactgaatcctaaaataaaacattcaaaattaccttaaaacgtggaataaaataatgatacattttgatattatgggaaaacaaggacaaagtaagacatgaacaaaaaaaaatcacatttatttgataagcagtttggttttgttttcaatattaaatgttcattctcagtatgacaccaatgaatatagtattaacaggtaagatgagtgggaaaagcacctcttctccttgaggcgggcccaggcttctgtgcatgtgcttgaccagggccgtcaggggcgccatgcactcatgccgattgagctcgtccatctccagctccagcacatcatcatgcaccgtggggtcccgctgctcctgcgaaagggagggcccaggagagcagagggtacagttaacattcagtggacaaggcagtggatgtgggaggctctttctggggcaacagcatataacaaacacttaggtaataatgataatctggtaataatatcaaatacactcactgtacaattaacagataagaaggatttcatgtcttccttgcatcccaagtacatagtccccgtcccgtctgcccagtcattccacagggtggctcctgaggtcagatgtctctgttacactgacccctgacccccatctatggtcactcctcagggtggctcctcaggtcagatgtctctgctatgtgaccccctgaaccgtctgtatggtgactccccgggagtgcacctcaggtcagagcatctttgctatgttgacctctgacctcctactgtgctgatgatatctgactgctgagtctacagaataaaaggctaggaattagatcttggaaaattctccaaattaactctatactccgagggttgtcaatggacagagaactggcttcctgtagtaacagcaaggcatagctgtgaccccctttcttcacaaacatcgacaatattcttttagtatgtgaaatgtgatcacccgtctccgaaaacgaccagtggcaggtctagggtcttgggagctgtatgaatagctctgaactccggttgagaaatcaaattgactcatttcctcactcagggtactgtctgccaaatatgacagggaagacatataggaaggaccatctgaaatataaaaaaggagaaaattacatgtattcaaacataattagtaagaaatgtatttctctaaattcaaatgatatgaaaattaaagcacattttaatctaaggttttcatcaagccagtgattattaacctattatccagattaagaaagcaaaaaagaaatggggaaaagacctcattttctttttgttgttatcaagcagttattctgtcatagacaaggaaattgttatactggtccaattttgcatatgattaacacattttctttgcatttaaaattttgatgatgtacattttgcccattaagtctaacaaaaatgtgggaagaaataccactgaaaagcagctaatccaaaacacctaagagatttagaaaactggtccaaattttattctcatatcaagaaatgatgataaagctataaggaaaaattaagcaaaaaacaaaaacaaggagcatatagagggatagtggactaattttaaatagggaggccaggaagagtctacttcaggggttgacattaaacaaaatgtcatgaggtatgctaatacctggggttgagggtattagaggaaactgcaagtgcacacgacctagggcaaaagcaggcctggcgcctacaaggcacaggcaagagccatatgctggagtgagcagtaagaagggctgcaggggagggagtcggcaggtcaggggccttgagcagctctgtcctgccggagatgggaacccacagtgaggctgggcacagaagagtggctcgaaaggacttgtattctaatgtagacttctgaatgtatctaaacaacatacaaacacaatccatatgcaaacaataagacaccaagctaattttgtatttttaaaaaagtgtaacatatctgaaccccgtctggccactctgagacctttctatgcagctaagtttagctaagtacatttctttcaaaatataattccatttgccacttaaaatactttttcaaagtcaatttcaatgttttagggtacttaaagtattttctatttacataaaaaatactttactcctctatttgtcttagaacaaaacaaaacaaaataacccatcgatttgaatcctttctcatgattttgaaaacatcctacctgaatccccatttgctgcttctctggcttctttcctaatttcaatgtactttttctttctttccataggaacctattgggaagaacaaataaacaatgtaaaacattttataataatagtgatactttttctgttttagtagcaatctggcaaaaaaaaaattataaatttttaaacaaaacaaaacaaatttaaaagcactcaaaaataacctcaaaaagagactagtgagtgtcccttaaggaaagcccttcctgcagattcccacagaactcggcccaggcacttaacctccatctcagctctggtacagctcactgcgtacagtgtgtaccaaactcttatgcctggactgctgataaattctatttatctctgaacctcaatttattcaaatctagttatgatatatcatagtgcttgtaattgttgtaaaatatagaagtaacatacagcatgtgtctacacgcttaataaactggtgctaattttgttgttttttagttctttgaacatatgcctagaaaacaatcctagtcttgttcagaagaagtacaaggcaggatcagcattcacatgtagtggtgaagcactaagacatggtagaggtcagcagctgtgtggggaaagtgcacgccatggtggatgagctcagctctctgcccaccttcccatttccaatgggtgctgaaggcagcaaccaccacattctcaccaactgcccaactgctgaggctggcatgtcaatctgagcttggctaaaacaaaccttgtcccatctgccagagcaagtcttccagttaacccatgacttttccatgatcctgccacgttgcccaagcaaggccactgtaaggatctcaacttctttgactggagcaattcacttagaaaacaacttctgggatatgtcctaacacttccttttactggcaccgtctttcctacacatgtcaagagatgaaatcaagttctgacaaattttgtagttgcctgagattgtatctgaagctacaattgccagattttatagaaaccacatgaaaccaccagtttttgttgaaagccgacttgaatattggcaacttaacgtgtttgacataatatggttttctttgtgagcacttgataagttttttttaacattgaaaatttcactcacctcaacttctacaggaaaattatagcggcgcttcaggtcgatcagattttcaaaaataagcaagttctgtgaatacaaagaatcatataaaaatagctgaatggtgaagatcctcataatcgatgttactttagaattaatgctatgtaatagctcatggaaaagcactccagctttaaatatacctatgcagaattaaacgaaccacatctttaatataagatggtataaattatctgtaagtttgactgatataatctaacttttgaactcctacaataacaatagtgcacaccgtaggagtggcctaccttttctggtttttcactaaacagaaaaccttggtaaaattttaactcattgaagacacagcagatgacagatatggcgcagttgtatgctgcacaatggtaaagtcttctcctctccagcagctgattctctcctgccatgttctctgtaaatgcatcgtagcacaatctgcagagagatccatgtgacaaatcaattcacacaacatggcaatcactgctcaagcccaacaatgccagacaacaggacctaatgccattcagcctttctcgagggtcaggcttgtgccaggcagagtattaggcactgggaatatgaaaaggaacatgtcatccatctcacagcaaaggcagcatatatacatggatcttgcaacacagtggtcagtgacgcaacggcatcaagtgcagtaagtaaagagagggaaggaagcaaggaggacagacaacagcctagtcatgactgaacggtgacatcattcactgatgaggtaagacagcaccaagtaagaggagggtaataatgaatttgtttggtgatgcaaaatgtgatacggcaaaagtctgtgttcaatatttactaggaggagaactccattaaaagacaagttttagagaaaatacatttgattacttttgtattgtttagaatgcctgttaaaaaatatttactatgcctttaatttcaaatctcagaaaaaataaaatactctaaatcttttgttactgaaaatcacagcactaaaaatatatcaagctattcaaggggaaaaacagtaggaaaagaacagtaaaaggaaaaagttttattatttgtaaaatattagtacaagataaaacaactgttatccaatacaccctaaattaacgccctaattaaagttcacctaagtggtttataagaagaaaactataaaagctcagtatctaaataaaatatttattcacactatatacatacataaaaatatatgtacccaaagcattgataaataaaatagaatccaaaattaagtaaaatcttacttaatcaatgtctttgtaagttcatttccttctgtaatacacgagccatggaaaacttgattaatttttgattccttagcatgaacatcatctttgggaaggcgagaatacatcacgtctagaatcttatagtagcccatcttcttggtgatttgagtatcaaaggtagattcatttagcttcaaaaaggtaaaaaataattatctttggtcttattaaacatgaaatacatcttatagaatatatcaaatttaatacttaatatcctttagacagacagaattttaacagtcaaaaatgctaaatcacttcaataagaaagcatgcaattgtccaggtctagaacacgaatataagcattgatatgttacactggtgaagcaggaaataatgtgtgacatccaaatagtgagccaagggtagaaaatgtttgcacaaaatcttactgaagacatgggaacaacaggtgaaaatccaaaattctcagctattttgaagtctgcattaacaatgcagcatctgggtattcatagtatttcccaacaggattccgagggaggctgagtgatacatcctgccctcgccccacaaaaagtatccaaaagatgccctcatccctgaaacctacctcctcatgtggcaaaaaaggactttgtagacaaaatttagttaagggccttgtgatgaggagattattttggattgtacaggtgggtaggccataaatgaaatcacaggcaaccttgtaagaaggatgtgtagggagattagatagacaggaaatggaaatgtgaccagggaggaagagaccagggtgaaaccagcacaagccaagcaatgctggcagcccctaggaccgccaggaacagctcttccctgagttcccagagtgagcgtggccctgacaacactgtgatgtcagcccagtgaaactgattctggacttctggcctccagaagtgtaagagaatatccaaatttgcgttaagttgttacagaagccacaggaaataaaggcagatcccatgtagccacagactgttatgtggcacactccttgaacagcagaggccatgtgactgagcacacagcagtgtctaggcacaccagtcaagtaggctgctcacttcttattactgatttaaggcgtatgatacctttgtaaacctggacttcaacacatcaatggcatccaccacaattgtgctgaagaattctctcaaagcatccaggctacagtgccacagcagagtgaggagggagcggtccacaaaggactggcgtgtgaaacttaggcgggggtcatccttcctgaacatttcatacacgctttccagaaggcctacttgtgtgacacatgaacccctaagaaaacaagataaaattatatgaacatccctgctttgaagaggaactttatgagtgcctactacataacaggcaaagtaaacaccagtgattacaaattacaaaaataactttaaggactatatatatgcaaaatccacaaaacacaaaaagcatttgcacatgaaccatactacttttatccactccccaaaatcttcaaatcaaacatgggcattaaaaagaagaatgtttcatttactttcaaatctggtcttgcttaaagaacatctggaaggctctagaagaatctcaagcctaaaaaatagacacatttctaggatataaaactcagaagttggctgggcgtggtggctcacgcctgtaatcccagcactttgggaggccgaggctggcagatcatgaggtcaggagatcgagaccaccctggccaatatggtgaaaccctgtctctactaagaatacaaaaattagctgggcgtggtggtgtgcgcctctagtcccagctactctggaggctgaggcaggagaaacacttgaacatgggaggcagagggtgcagtgagccgtcgcaccactgcactccagcctggcaacagagtgagactccgtctcaaaaaaaaaaaaaaaattcagaagttatgattttaaaattctagtttctccctaccagtgaaccaccattgctatttcccaaacagaaatatacctgtctatctggtcctttattttctcacctgaaaataatatatttgaataatcacctataaagttttgtctataaatctataaattaagaatgcagagttagtatcttcatctgtaaaaataagagggttaagactaaatggccattaaaattctgatgctatgaagttagataaccaggtcaaaaatactagattcagaaagtaactcagtcataaaaagactataggacactactagatgccatacaggatttgcaaagtttatttgggtactataatggactgaatgtttaagactccccaaattcctatgttgaaaccctgatccccggtgtgattgtattaggaggtaaggctgttgggaggtgatcagtgcccttatataagaggtcccagaggccgggtgcagtggctcatgcctgtaatcccagcacttcgggaggccgaggcgggtggatcacctgaggtcaggagtttgagaccagcctggccaacatggcgaaaccccgtctctactaaaaatacaaaaattagccaggcatggtggcaaatgcctgtaaacccagctactcaggaggctgaggcaggagaattgcttgaacccagaaggcagaggttgcagtgagctgagatcacaccattgtactcctgcctgggcaacaatagagaaactccgtcgcaaaaaaaaaaaaaaaaaaaaaaagaggccctagagagttctttgccccttctaccatggatgactcagagagaaggtgctgcctataaagcaggcaagcgggctgtcattagacactccatcaactggcagcacgttcttggacttcccagcctccagaaccatgagaaatacttttctgttgttttataggccacccactctgtgctattctgctatagcagcctgaaaggaataacacaggcaccatcctaggctcattttctcttgaggagctttccactagcaagcacagtagagatgcacataaaacatctgactcttacctaaaaagctaagatagtaaggagaagcaaaataaaaagagcaaagacctaatgttaaaaatgggcccacagatgatttactgaaaaatgcaaattaaatatataaaaatatgcctgactttactcataataaaagaaaaattaaggtaacaaagggaaaccctttctcacctataaattggaaaaaatctgaatgtttcacaatgttggccagacagtagtgaaacagatacactagtatattacaaataagggaggaatgcaaataatacagccccaaaagaagcaatacagacatacctggcaaaattacaaatgtacttaccttttcatctgcatttaggaatctaccccaaagatacacgggcaaatacaagatgatataaacacaaggctattcacaacagcattattattattattttaaaatattttttgtaatgatggggttctgctacgttgctcaggctggtctcaaactcctgggctcaagtgatcctcctgcctcagcctcccaaagcactgggattacaggtgtaagccactgcatctggcttccctgtggcattatgtttaacagcaaaagattgaacccagaagtccattggcaaagggctactttaaaatactatgatatttctttgcaatgaagaattaaacactaattttttaagacaaagaatgaggaagatttctatatgctgatagggcgagatctgtacaagacacaagtggaagagataggaaggtgatggggcaaaagaggaacaagagaagggcccgagatggaaggaagatcctctgaattgcagctcattatatagctttgattttagtcatgtaaatatcatacatgttcaaaatgaaaattgagtcaaaagaaaaaacaaaatttctaaaatttgaaagttaaataagcactactaattggtgtaataaccacacatcaagaaaaaactacatcaaatgattttggaacacaaaatttgactgtatatccttagatggcatgtactaagaaaattatagctaaaatgaaaaatttaaacttcatctagctgtcattattctatgtaatcatactggtattgttatttttgaaagtattttgtgcatattgtaaagccattgagtaattatagactatcactggaaacattagaaaggaaaagagaacaagatgcacagcgtaaaggaataagaaaagaagttacattaaaatcctgtaaaacagaaaaaagaataagaaaaaaattttaatagtaaaaaatttagttgccttttatttatttttgtttattttttcaggctctctggccttgttcccaatctcaggaggaagcatgcactccttcactattacatattttgttggctattggtttttcatagacagcctttgtcagttttatcacaaatggatgttgtagtttgtcaaaagtcttcctgcatctactgaaattataatgagttttcttcctttattctattatatggtatctaagactaactgattcccagagagaaaagcaacctttcattcttacaataaacaccaataggttatggcgtataatgttttgtgggtgttgctgaatagcttaatgtatctttaaaaatttttgtgtttatattcatgaaggatacttactggtctatagttttcttgtgctgtctttctcttatgttggtcttgttactcgcctcacaaaaggagttgggaagtattccttcctcctctatatcctgaagggtttatgaactactggtacaatttctttttaaatattttaattccgggtatggcggctcacacttgtaatcccagcaatttggaggctgagaaagaaggatcatctgagcttatgagttcaagaccagcccaggcaatttaggaagaacctctctacgtttaaaaaaaaaaaaagaaagaagaaaaaaggctgggcgtgatagcatgcctgtagttccagctactaggcaggctgaaggaagaccacttgagcccagaagtcaaggctgcagtgagccatgatcatgccactgccctccagtatgggcaatagagcaagaccttatctcaaaaataataaatgaatgaatgaatgataaaattcaatggaaggagtggaccaagaaggctaaatagaagcctccagtgattgtctcccccgcagaacgccaaaatgaacaactatctgtataaaaaagcactttcataagaaccaaaaatcaggtgagtgatcattgtacctggttttaacttcgtattaaggaaagaggcactgaagaaactaagaaagatagtcttcaatcagctacaccactccttcctcatcccccagcagcaattgcacgcaggacacagaagctgtgcacttgggggaggaaaagcacagtgacggggcactttgcattggaactcagcgatgtcctgtcacagcagaaaccaacccagggcagaatttagccagcactcactgggagaacatttagaccagccctaatcagaagcaaactgtccatcccagtggtcagaaactacattctggcaagccctgccaccatgggctaaagtgccttggggtcccaaacaaacttgaaaagcaactaagatgacaacaattgcaattcttgggcaagtcctcgtgctgggctgggctcagaacaagtggacttggggggcacataacctgagataccagctgtggccactatgggagtgcttggccatgcctccccaaacccaagtagtacagcttgcagtaataaaagtgattcctttcttctgcttgaggacaggaaggggagagtaaagaggactttgtcttgcaactgggataccagctcagccacagcagaacagggcaccagggagaatcctgagtccctcactccaggtcctggctcccagacgacatttttagacacactctgggccagaagggaacctgctgccttgaagggaagggctcagtctgatgggattcatcacctactgactaaagagcctttgggtgacgaattatcagtgctaaccaggtagtacttgccgtgggccttggttaagacccagggccacgctggcttcgagtgtgacccagcacattcccagttgtggtggccacagggagaaaccatttctgcttgagagaaggagaagtaagagtaaaggagacttgcataatgtttcatgccttgcaacatgggcaccagcttggccacagaggggcaacatcccaagcgggcttctgaggtccccagttctaggccttggctcttaggatttctggacctgccctgggccagaggggagcccactaccctgaagggagaaactcaggactggcagcattcaccacaagctgactacagagcccttgagccttgagtgaaaatcagcagtagccaggcagtcctcactgcaggcctggggcaatggtgaccacaggcagagacttctttattttaggaaaggagagggaagaatgaaaaggactttgttttgcagcttggctgccagctcaactgcagtggaatagagcaccaggtaaattcctacagttcccaactctaggcctggctcatagatggcatctcttgacccacctggagccagggagaaatcactgtcttgaaggaaagaacacaagactggctagatttgcctcctgctgattgtacagccactgggccttgaatgaacacaggcagtagccaggcagtggtcactgaaggccttcagtgagacccagtgctgtgctgtgctgtgcttcaggtctgacctcatgcagtcccaatggtggtggctacagaggtgctcatattaccgttcccccagctacaggtaatcagcacagacagagagactccatttgtttgagaaaagtaagtaaaggaaacaagagtctctgcctggtaatccagggaattttccaagattgtaccaagaccactaaggtggtacctctataagtctgtaagaaccacagtgctactgggtttggggtgcctcctacagcagattaggacttagggtggcccctaaagcagacatggcttcagtgaccaaagacttagatcatacccccaagtacctacaaatacctggaaagtcttcccaagaaggaagtatataaacaagcccagaagactacaataaatacctaaaatctttaatgccctgatatcaatgaacatccacaaccatcaaaaccagccaagaaaacatgacttcaccaaatcaactaaataatgcaccaacaccaatccaagagagacagagatatgtcacctttcagacagagaattcaaaatagctgttttgaggaaggccaacaaaattcaacataatacagaaaaggaatccagaatcttatcagataaattaaacaaagagattgaaaaaattaaaaagaatcaagcagaaattatcaatctgaaaaatgcagatgacatactgaagaatgcactggagtctcttaaaagcaggactgattaagcagaagaaagaattaatgaacatgtaggcaggctatttgaaaatacacagaggggacaaaagaaaacagaataaaaaacaatgaagcatacctacaagatctagaaaagagcctcaaaagggcaaatcaaagacttactggtcttaaagaaaaggtagcgggagacaggggtagaaagttttttcaaagggataataacagagaactttccaaacctattgagaaagatagcaatattcaagtataagaaggttatagagcaccaagcagatttaacccaaataaaactacctcaaggcatttaacaagcaatcacccagaagtcaagaataaagaaaggatcccaagagaagcaaggggaaagaaacaagtaacatacaaaggagtgccaatacatttggtagcagacttatgggtggaaactttacaggcgaagacagagtggtatgacatattgaagatgttgaaggaaaaacattttttcctagaacagtatatccaataaaaatatccttcaagcatgaagactttcccagaaaacataagctaaaggattttatcaataccacaagataaatgctacaagaaatgataaaaggagttttttttgttgttgttgtttttgtttttttaagatggagtttcgctcttcttgcccaggctggagtgcagtggcacgatcttagctcactgcgacctccacctccagggttcaagcgattctcctgcctcagccttctgagtagctgagattacaggcacccgccaccacgcctggcttatttttagtagagacagggtttcatcatgttgaccaggttggtctcaaactcctgacctcaggagatccaccagcctcggcctcccaaagtgctgggattacaggcgtgagccaccacgcctggccaggagttctttaatatgaaagaaaaggacattaatgagcaataagaaatcacctgaagtataaaactcactaataagtacaaagaaaaccatagaatattgtaacactgtaattgtggtatgtaaactacttatattttgagtagaaagactaaaaagataaatttatcaaaaataataacttttccagatatagacagtgtaataaggtataacttgaaacagcaaaacgtttaaaaagcggaagatgagattaaagtgtataatttttattagttttttctcttgctcatgtgtttgtttatccaatcagtgttccgctgtcagcagtttaaaatgagttatatcatttgcaagcctcacggtaacctcaaatcaaaaataacatacaacaaacacacaaaaataaaaagctagaaattaaaacatatgacccgagaaaataaccttcactaaaaggaagacaggaagggaagcaaggaggaaagaccacaaaatgaccagaaaacaaataacaaatggtagaagtccacacttatcaacaacaacattgaatgtaaatggattgaactgtccaataaaaataaagtggctaaactgatataaaaaagtaaaaaaaaaaaaaaaaaaaatgatctgttgcctgcaagaaacacacttcacctataaacatccacacagattgaaaataaagggatgaaaaaagatatttcatgccaatggaaaccaaaacagagcaggagtagctgtacttacatcagacaaaatagatttcaagacaaaaagtataaaaagggatttttgaagtcattatataatgattaaggggtcaattcagcaagaggatataacaattgtaaatatatatgcaccggtcactgcagcactcagatatataaatcaaatattagagctaaaggggtgagacagaccataatgcaacaacagctgaagacttcaacaccccgccttcaggattggacagatcttccaaacagaaaatcagtcaacaaagaaacatcatactcaatcagcactacagactaaatgaaccttacagatgtttacagaacatctgactcaatggctgcagaaaacacattaccctgataggcacatggatcattctcaaggatagagcatatgttaggccacaaaacaagtcttaatacattccaaaaaactgaaataatgtggacaaaggatataaattgtacagccagtatggagaacagcatggaggttgctgaaaaaactaaaaatagaacttccatatgatccagcaatctcactgttaggtatacacacagcctgggtgacacagcaagactccatctcaaaaaaaaaaaaaaaaaaaaaaaaataggccaagcgagttggctcaagcctgtaatcccagcactttgggaggccaaagcgggtggatcacctgaggtctggagttcaagataagcctggccaacatggtgaaaacccatctctactaaacatacaaaaaaaatgagctgggcaaggtggcactcatctgtaaccccagctactcgggagggaagctgagacagaagaattacttgcacctgggaggcagaggttgcagtgagccgagatcatgccactgcactccagcctgggtgaagaaaggaaatcagtatatcgaagaggtacttgcactcccatgtttactgcagcactgttcacaacagccaaaacttggaagcaacgtatgtgtccatcaacagacaaatggataaagaaaatatacacagtggagtactatccagccatcaaaaaggaatgagatactgtcatttggaaaaacgtgaatggaactggaaatcagtatcttatgtgaaataagtaaggcacagaaagacaatctttgcgcgttctcacttacttgtggcatccaaaaatcattaaaacaattgaactcatggagatagagaatagaaagacggttaccagaggctggaaagggtaagagggagggggaaatggggatagttaatgggtacaaaaacatggttagatagaataaataagatctagtatttgatggcagaatagggtgattacagtcaatggtattttgctattttttttttttttttttttgagacggagtctcgctcagtcacctgcctcccgggttcacgtcattctcctgcctcagcctcccgggtagctgggactacaggcgcccaccaccacgcccggctaattttttttttttgtatttttagtagagacagggtttcaccttgttagccaggatggtctcgatctcctgaccttatgatctgcccgccttggcctcccaaagtgctgggattacaggcatgagccactgcgcctagccaatattttacatttttaaataattaagagtataactggattatttctcatgcaaagaagggataaatgaggtgatgaatacttcagtcaccctgacctgattacacattatacacctgtatcaaagtgtgattattacacattatacacatgtatcaaaatatctcatgtaccccataaatatatgcacctatgtaccaacaaaaacaaaaatatattacatatctgggccgagcactgtggctcacgcctgtaatcctaacactttgggcggctgaggcgggaggattgcctgagctcaggactttgagaccagcctgggcaacacggcgaaaccctgtgtctactaaaaatacaaagaattacccaagtgtggtggtgtgtgcctgtagtctcagctactcagcaggctgaggcacaagaatcacttgaactcaggaggcagagactgctgtgagccactgcactacagcatgggagacaaagtgagactcttttgacaaaattcactagtagctatctggaggccaggcacagtggctcgtgactgtaatcccagcactttggaaggccgaggcaggcagatcgcttgagcccaggagttcaagaccagcctgggcaatatggcaaaaccctgtgtgtatataaaaaatacaaaactagctggtgtggtggtacatgcctgtagtcccagctactcacgaggctgaagtgggaggattgcctgaacccaggaggaggtcaaggctgcagtgagccttgaccactgcactccagcctggataacagagtgtgaccttgcatccaaaaaaacaaaaaagctatgtaggtctgggatttccttcacagaaagatttttaattattaattcaatttgattacttgttgggggtgtattcacacattttatttcttcttgagtcagttttggtaatttacgactttctatgaatttgcccattttgcttaagttgctgaatttgctggcctaatatttttcgtaatattcgcttataatcttcttacagtttctgagaggtcagtggtaatatccacctcttttcattcttagttttgacaaactgtggttcttcctttatttttggctagcctagctaatggtttgtcaactcctttagctttgattgtgaaaacaaatactgatttttctccaccatttttctgtttcctattcccttcctttgtattaccttggtttagtttttttctttttctagattttaaggtaaaaagttcagattactaatttaaatctttcctattttcaaacacaggaattaaaagatacaaatttccctctgaacacctatttagttgcatcacatttggataagctttattcttattttattcagatcaaaatgctatctgacttcctttgtaatttcttatttcacccaagggctatttagaaatatattatttacaaacattttcagattcccaaaatttccttgtgttgttgaattctaatttaacttcactttggacagagaacatgctttgtatgatttcaatcttttaaaatttatcaagacttgtttttatggtctagtatatagtctgtcctaaagaatgctgcaggtatgctccaaaagaatgtgttctgctgccgtgcagaattctgttttatagttggttaattatgatatttttaaaaatatcagtagaaaggaatgaactatgtcatggatgaacatcaaaaatattacgctgaacaaagaagccaggaataagagatcacatattgtatgattccacttatataaaatgtccagagaaggcagatttataaagacagaaagtagattagtgtttgcgtggagctaggatcagcaatggcagtcaactgtaaatggtcctgtggggtcttactggggaataaaaatgttatatggtgctggttgcatactcaataaactacctaaaaatcatggaactatatacttacagtgggtgaagtttatgatctgtaaaatacaactcaagacaaatttacatggatatttacaaattcaatatagataaatgccaattttaaaaattcattggaagtttactatgaggagtagccatggcatcaaacccttacttcaaaaatcaataatcggggccaggcgggatggctcacatctgtaatcccagcacttagggaggccgaggcaagcagatcatttgaggtcaggagttcggaaccagcctggccaacatggtgagaccccgtctctactaaaaatacaaaaattagccagtgtgttggcgtgtgcctgtaatcccagctactcgggaggctgacgcaggagaatcatttgaacccagaagacagaggctgcaatgagccaagatcatgccaccgcactccagcctgggttacagagccagactctgtctcaaaaaaaaaaaaaaatcaacaatcagatatgtcctatccttcccactgtatttttgctaaaatactaaattgcatttttggtaaccaaacaatccgagtgatgagaccttcattacactgtaattccaggcactaaatttagaaggaataaaagaatcagaaaaatggccatttgcaactcttaatgaaataagtgattcagggcaatcatcataaatagagctaaaccatgaggaaaatacaatcatgcacatggctagtcaatcctagcatcactaaaagcaggatcaccagacattatgcacctcctaatgccgtgaataagaagtataaagtatcaactattagtcttgccaaaatttcaacctgaatctaactgtgcttttagacataactttccatttacagaaaatccaagggctagaggaagaagttcaatgaaagcaaaagaatcagataaatccagaatataagacattatacaggacaagtgtccaagtatctccaaaaacaaaataaataatagaggagactgttttaaatgcagactgaagagacataacagtgaaatgccatgtatgaaccttgtttggaccaaatttcaaataagccaacactgtcatcttgtttgagactactgaggaaatctgactatggaattactgataatttcgttcagttgataatggtactatggctattcaagaaaactgctttaagagacatatacagaaggatttaagaggtgaaacgacatggtgtcacagatttgctttaaattacaatagcagtagcaaaaaagaaaaatgataaaaggccaagatgaagcttggaaaatgctgaactttgttcaatctggggccttatttatactcttcctctagctttgtgtatgtttgaaaattataataataaaagttttgttttaaagacaaaaaactaaaataaagtttagtagcaagaatataattgccactcagctttttttttggaacagagaggataatttcccacaaaactgaaatgcgtatggttcctgagatcccaggccagaatgacttaccttctggcaatcctcctgaaactggattgaaataattcttccatgacatgctgctgttcccgacaaagaacttctgtcatcaattccaacaacatagggctttgagataattccaatgcatctagaaactagaaaaaatacatcaacatcattaaaattttgttgggttttacttttgcttcaatagttaaattatatactaaaaatataaaaagtttcttatataataaaaaatataacatacagaaaaatacaccagaatttcacagacttaacaaataccagtatttctgtcatttttacaaatattgttgagtggctggtatatatcaatgttcactatatactgagcctagattctttctaggtttttttttaggttttttttttttttttttggagacacagtcttgctctgttgcccaggctggagtgcagtgacacgatctcggctcactgcaaactccgcctcccaggtttcacgccattatcctgcctcagccttccgagtagctgggactacaggcgcccgccaccacgcctggctaattgtttgtatttttagtagagacggggtttcaccgtgttagccaggatggtctcgatctcctgacctggtgatctgccctcctcggccacccaaagtgctgggattacaggcgtgagccactgtacctagcccctattctttttaggttttgcagatgctactcttctctgcatctcaggttctgagagtacatggagacgtgccttcaacaggcccccctccttcaccatgccagggactctcgcccttactctgattctggtaatgtgcatcttttccacaccgtcctcgctacagaggggatatcccaggccgctcccccgatgttctcatcttgactctccccttctccatctcagtttctgttctgctttctaggagatacccttaattttatcttcagaatagaacaagtatgttttatttaaattttgcttctgcatatttaatttccaaggatccttatcctatctcatggacataataccttctttcatctctgaaactgttgtgtgcagtttccactgcacttcagcctagacgacagagcaagactctgtctcaaaacaaaagaaaacaaaacaaaacaaaaaacaccaatgtatttcatgtctatgtccagacttgagtcctatccccgggatatctcatgtatacacaaacattccaaaatccgaaacacttctggttccaagcatttcagataagggatgctcaacctatcatattagggataatcacgaaatgcttctcaaataatcgctactctattaaattttagaaactggaaattattggtaatattctatttcttagcttcttttggtattactcttcataacttacatatattttacacattccattttacacataaaatatttcacaattaaaaatgggagaaaaaaacaaattccagtggattcacatatactcctgtcactgctttccaagtgaattaaatgaattctcaggccacacacacataaataaatgggacatggtgctgattcagtatgtgcttcctcttctacaaataatgaccctagtaaaaatgtactgtacaagctttgtgtagaaagaacattttgaataacctattgggtggtttacaacttctctgattgtggatattttactcacctcttttcatcaagatatgtaacaagaaaaaaaaaacagtgttttaattttacttgatactactagaaactaacctttttcatgcagtccacataattattgaaccgcggagttcctggaggaaattccctggactgcatggggaagtgagcaacgatgagctgctccagaacacgtctaagttcctccagactgcctccagtgaggctggtgaagaatggaagaagagtgacagcttggccctgtggagcaagacagacataagaaactgcacgaattatggcttatatatcctacagaataaataaaattactgtaagacattgcaaataaagcattatgtggaatcaatgaatggcttcaccataatttctaaattatattaaaaaccaacatgaatacaattctatacctcagcttttttttttttttttttttttttgagacagagtctcactctgtcacccaggctggagagcagtggcatgatcttagtaggctcactgcaacctccgcctcccgggttcaagtgattctccctgcctcagcctccagagtagctgggattacaggcgcctgccactatgcctggctaattcttttcatatttttcatagagacggggttttgccatgttggccaggctggtctcaaactcctgccctcaggagattcacctgccttggcctcccaaaatgttgcgattacaggcgtgagccaccgcacccagcctatacctcagctttgactcttacccaggctagttggttgacgccagctatggacacataaataaatgggacatggtgctgattcggtatgtgcttcctcttctacaaataatgaacctagtaaaaatgtactgtacaagctttgtgtagaaagaacattttgaataacctaaggaggagtttacaactacacattgcagaactacagaagaacttcatactgagcttaacaagaactaggagttgactcctgttctccctcgcatggcagaaaattccaagactgtctatggagaaatgggaaacttgattaatcacacagcagaaaattccaaagaattatcccctttatccagtaaaaaggtcccttgaattaaggccacttttcagtagggtttaaaatctaattgttctaggactttaaaattagtaacccttaaaatgacagtatttattaattcttgaccctaaaaatcaccaaaaatttttatattattttaatagaaaaatgactgagtaataaagtcattatagcacaaaaagccaatttaaataatatgtatgcaaacacaaatgttaattcatccaaatatgataatcttatactttaaaagaaatgttctaggccgggtgtggtggctcacacctgtaaccccagcactttgggaggccgaggcaggcagatcacttgaagtcaggagtttgagaccagcctggccactatggtgaaatatactaaaaataaaaacattagccaggcctggtggcgcacacctgtgatcccagctacttgggaggctgaggcacaagaatcacttgaacccaagaggcggaggttgcagtgagccatgattgtgccactgtacttcagcctgggtgacagagcgagactgtctaaaaaaaaaaaaaaaaaagaaagcaagaaagcaagaaagcaagaaagcaagcaagcaagcaagaaagaaagaaatgttctcatgtcttggagaggcacactgaactgaagcagatacaggtcagataacacacccggcctgcttggccttccttgcctgctgacgggtgggttgaccgcacaggtgaaacaaacacacccacacaggatggttatcgagactggctaataagtacgggggattactgtgctagtctccctacatttgaacacgtttgaaattttccataataaaaaataaaaaacatcacaaataaaaaatacgaaaacagaagagaatgtaatccaaaaaaataaatatttcactgtttacctttaaatgtagatccagctttgtgtcagcaagtagactaatatatgttgtaaagacttcagggaatgaaccatgacttgtattaaaagatacagatgaatcaatctaaaggaaggaaaagaaaaacaggacacatttgtatattacatctctatttcctttagcccattgctcaaatgtttaaattccagaaatgaattgttaatttaattttgggcttcaataatattttcacaatcttattgtaaaacattgtaatactatctgttaggacaatacatgcaaaggtactttaaaaagatatagcataagaaatagtaagtctaataaataatggaaaaagtttaaaaaggtaaatataagcaaccatcctgtcaaaatattttcttatttgtcaaaccaatgagcttttggagcaacctccatcaaattttaaagacacaagttacagagttcagaagaataaacatgactgctttttaaaggaattgaatacctgtaaaatttttgccagtaaggccagcactgccattttagtttcgagaggggaatctttggcccaccatgaatcacacttcttccagtgttgcagaattgtagtcgcaagtttcagtccttggtgtttctggtttgctcgctccctgaagctctggtctaacatgccgttcaaaacggcactcacctgagacaatttcgttgtgagtgaagaaaaattcttaattttgagaatgacagaaaacaaaatttacctttatttcaaagctattcttggaaaataaataagctatttctataatagatgtttatctacttcaaaactcctcgagtttgatttgaggtacactttaaccatagtttttccacaaagtacagggtggccttagctatgtcatcaggctcatccagcttctcctggctttcctagtctgcgcagtctaggaaaaaggagtcagctctcttctgtcaccaccaccaccactgtacatgcatgcacaagcacacacaggtgtacacgcacaagcacacaaatatgcacatatgcacaaatgcacacttcctatcccaccaccactgtacatgcatgcacaagcacacagatgtacacacataagcaaacatgcacccaagcacatacttccggtcccaccaccaccatacaggcacacactagcacacacaggtgtacacacacaagcaaacatgcacacacgcaaacgcacacttcttgttcaactaccatcatacatgcacacccacattttctgtctcaccaccactcctgcaacagagtgacaggctaattttggtcagattaacatgcactattcctgtcattctgactatgcaaacatttttcacagatgttccaagtagaaacaatgcttttccctttttgcacattttgtactctctgaagctaaccttgtttgctttcattgctcttttcaatgtgtctgtcattaattcgtcatcaaactctcccaagttatgaaattgctgcaagccctctaagcctatcaggtctatctgccccatttctgtggcaactcagctcttgatctgcaatgctggtgctggacctggtgctgggccatccacgcctctgtgcggggccgacatactgtatccagcaccttcccctgtcttggctcactgcctgatcactctctacccagcagcatcgtgatgagagtgcacagggacctcttggggatctggcatgtctaaaacatctgtattccactctcacataatggataatccagctggattcagaactctaggctgaagatttctcttatgaactatggaagaaatctggttcaagtcttgcaatgtccacactgccgctgagaagacatatgtcattcaatttctagatcctttcacacataactgctttttctccagtggaaacctgagaatcttttattgtagtgaaaccccacggttctgaattctcaagaaatgtgctccacgtggagctgtttctgtgcaccatgctggacactccatggccctcttctacctggaaactcaaagcctttgcttctgggctcctctggagctgtgtcctcagcaaatgccactcctgacccctgccctccggagccaaggccctgctgctcaacctcatgcatgaatccctagtctcctcctcttttctctcgtgttttctgttttgtctttcactctactctctgtgagagttactcaagtttaccttccaaactcatttcatttttaatttctgatgcctatgcttaattcccaagagccttttttgttctctgatgttcattctccatagcaattcttatttcacagttttgtctctcatctttcagttttttttctccagcttacatttccatctcactgaacaggccttgccacagttgcctgtgtcccgctacgccctctggcgtccctttcctcaggtgcctgagcccctgggctgccggctcacaggtatcacctgcctggaagcgctgtgcagcgtgcagggctcgctggtggggaggatcactgtcactgacccagctggctatgatgcctgcatctttattttctcttagggcttgtcaggatattctggtgccctgccaagggcagatgctgaactgaaagtattcagagggaaagggcagacagcctgaaagtctagaatttaggtaggttagtacttaactttcctcttttcctgatggtatccacatattcagccatgccagagcccccagtctggaggtctctatcctctccagggagtcactgcctcctgccttctcctcaagtggggaggatcagacccccagcagcagagacaggaggctgccctgcaggggagagctggcctttgcccaatcctctcttctcagcctctgctcacccctgctcgcatgtctgccctgctggggctcagcacgtgtggaccccaacttccgaaggctgcatcacctcgctgctatctcaaactctgcatgcagtctgccacacctgtccttttgatttacaactcttgtcactcttggaagtccttttctctgtgtcctttgagattgtagaggtgttttaaaaatctcattctgttactttagaggaatttagggaaggaatagaggtcaaaggcgtatgttttttctatcatttccatcagaggtcatagtttaagaaatcagaatgttaaatctgagtgtcatctactacgattttatttctaattttaaagaatacaaattcctactgcaatctaccacaaaagattcccctacaacagaaaagcactgtttgcaataaaagctcaacttaggacatcatgtactctcccttaaaatggtcatatcaacagttaacagtttctgtccacagaacaagttaaatttcaaaatcccagaggtttagcaaacgaaagtcaactatatattaaatactgatctccagggagaaagggggacacagcaggaacatgccagaaatgataactcagcatcgaggccacaagagaactctgagaacagagaggtctaccggggtgcagagacctgcctgcagctggtatgaatgcaaagccagctctgggccccaggacgggtttgtaagctccaaagccacatcttggcaaatgtcaataccctgcatagctgtgccttataatatttaggcttagaaatttgcaaagcataagggaatagaaaaaacaatcaatgttttaacatccaataacactcattagctatttcttacttttttaagacagagtctcgcttcattactcaggctggagtgcagtgggcatgatctcagctcactgcaacctccgcctctcaggttcaagaaattctcctgcctcagcctcctgagtagctgggattacaggcacacaccaccatgcctggctaattttttgtatttttagtagaaacaaggttttgccatgttcgccaggctgggcttgaattcctgacctctgatgatccgctcacctccacctcccaaagtgctgggattacaggcatgagccaccatgcctggcctaatattcattaactattgataaggggtatgttttgggtttttctgagtttgttaaaagcaagagctttcaaccttataggaaaaagtcttgtcatactttaatgaaatatttcaggaatatggcaacccttttataaggattatataagaaaatattgaccgggtgcagtggctcacgcctgtaatcccagcacttcgggaggccaaactgggcggatcacgaggtcaggagttcaagaccagcctggccaacatagtgaaactccgtctctactaaaaatacaaaaaattagctaggtgtggtggcgggtgcctgtaatcccagctactcgggaggctgaggcaggagaatcgcttcaatctgggatgcagaggttgcagtcagcagagatcgtgccactgcactccagcctgggcgaaagtgcaagactctgtctcaaacaaacaaacaaacaaaaaaaacagtttatttaaagggaaactttgttaccattttggtattatccactgaagactgcatgagctccaatacagcaagatccagatttttcaataattccgtgttgatcgtttctgagaacaagctatagaaatactccccatgggagaagtggatgacgctgccctgtgagctgcccaaggacgccgtggacagcaccgctgggttcaggagaagactcacaaggcgctcacactgggaaaaagaaaggagaagtaccataactggggcacatctttgcatggcacagaaagacccttgggcaactgataactttgaaattggaaaatgacacaggtctaaaaagagcctgatatgtgaagcctggattcaagctgaaattgtatatatttcaactagcctccattttctaggtttcattttgggaaagaaatcttccttgacccatatttcttccaaatgtccaaaagtcttgttgttgtgttttattttttgagacagggtctcgctctgttgcccaggctggagtacagtggcacgatctcggctcactgcaaacctccacctcctaggttcaagcaattctccggcctcagcacccccgagtatctggaattacaagtgcgttctaccacacctggctaatttttgtatttttagtagagacagcatttcaccatgtagttcaggctggtctcgaactcctgacctcaagcaattcacccgccttggcctctcaaagtgctaggattacaggcaataagtcaccctgcccagccttgttgttttttaaagacagggtgtcactctgttgcccaggctggagtgcagtggcatgatcatgactcactacagccttgacttcctgggctcaagcgatcttcccacctcagcctcttgtgtagctgggactacaagcatgtgccaccatacctggctaattttttaaatttttttgtagaaacagggtctcgctatgttgtccaggatggtctcaaactcctgggctcaagccatctgcctaccccagtgttgttgctttgaggatagtctattaagggtgagtatttttagacaatttaaatatgtaattgtttacattaatcggacaaaggggtgaaaaaggggtttctgctacagaagaaagaaagttgggatggagtgaacacagagggctggctgcagatttcagctacagcagggactatttaaggccagccctgcatggttcaaagagccatgagaatatttttttggagactctggttcctctgggattatccttcagaggccctcccaatcatccatgtgaaggaccaccaaggagaggagaagaggccacatgtcaacatgactcagcttcatagtcacaaaacgttctctagctaattccttttggaaacaaagtgggatagacaaaacctctatttaaaaagaatgttgttctattccgttctttttttttttaactattgagaaaataatcttttagaaagttggctcatgcaaatcatacaatacttgtccagctaaaaccttactacccaaattccacagtttctagagacacctgcaagtgacatatgtatttctattattaggggagtgcagcatgcagaggcgtttttcctaccagtcctccaaaagcaaaggctaactccagaagtccgctggccagctgcttacaactgaggtctagagaaggcagacactgtctctcatctccaggggcaatgcctttataaaccagggaaagaagttctgtgccaacagaatgatgcaaatctgtggactaaaaggaagccaacactgaaatgcctagcaaaaagatatttcttagaaaaaaacaacttcactcctctcattaaataaaaaacccacttcagatagcactgacaactaccttccaatattcagaaaaattttaattcaactttgcttttgttgttcttgctattgtgagacagggtcttgctctgtcgcccaggctggagtgcagtgacacaatcgtggctcactgcattctcaggcttccaagctcaagcaatcctcccacctcagcctcctgagtagctgggactacgggtccgcggcacccactcctggacaatgtttttttttgttgttgttgttttttaattgtttgtagagatgaattcctgccatgttgcctgggtcggtctcaaacttctggcctcaagcaatcctcctatctgagcctcccaaagtgctgggattacaagtatgagccactgtatctggctcaaccttgctttctatgctagattcttcatttgtgttgtcttgccacaaaggcacaacagcagttcctaaagtttttcagaaagctgctctgtaaatacctaaatgtcctttattttactttcattttatatttataaatttttacatttgctttcatatttatattgatatatcatagatatacagatacataatatctacatgtcttgagcaagtatttctataattcccatttcagcatgctcaatacataaaggacttttaagaaataatataaataaatacactaattatcatactaaagctaaaataaatgtaaaaacaataagttatagttacctgagacggtaatatattatgcagaagcccagctctgtgaagctgtttacaggcagacacaacagcagccagcctgctcctgtccacttgcgcgtcagggccatacaagttgacggcacaaagctcctcaatgctggccatgtgacaaaacagtaaattaggtgagctctgatctcgttaaattatcaagatacactgaaaaaaatgtttgcactgttatgaagcaaacagaggcaacatctaacaggatccacacgcactaagctagcatggagatcaaacatggcgctaaccatgtctgaagtttgcttaagtttggtacagggaaggcactagttaaatgtgttttctaaacaactattgaggtcactggcagcaaacatcccactgatataagccttccctgaggaagcaggagcagctgcaggagcacggcaacatactagggcctgaaattccaggacaacatgtccccgattgtgacccaagtacccacctctgtgctgttattttctctctcagatgggtctctaggatatctttgtatggggacatctttagagctttcatcagattcacacaaacatcaggaagatgagccataacctggacgtctccgatgttgaaacctatgcttgcgggctcacacagcgtctgcaccaggactctcatcaggtgtgtattacacaagtccttcttcaggagctgtaacagattgtttgataaaaacacttcgtcagccagcacttctattttcaccaaagtgcagggcccacaaggttgggaacttctgcctgactaagggagaggtgggcagagtttctctgtaaaacgggggcacagtaaacacttgaggtttgtgggctagacagtctctgcttcaactccttacgcgtctgataagaaagcagcacagacaacaggtggacagaggcgcacagccatgctcctatttagctttatctacggagcaggcagcaggtgaggttgtgtccatggacagggtttccccgcccctgactcaggacactgctgcatcccagggcctggcgtgccacaggcacctggcagagattccctgaatgaactgactggagtttgtttatacaataagcctcatggatacatctataaatatttgcgagtgtgtgtttcctaaggtagatgtttgatcatagcataaaatacagcatccaataaaacaattagaaaaaactattttatattttattcacacagtgaaactctgaaggacatgcaaagtttcatgattttcaatagatcattcatcatgatgactgtagttaataacgatgcattgtaattttgcaaattgctaagaaaatagattgaaaagttcccatcagaaaaaatgttacatatatgaggtaacagatacgttaattagcttgatttagccataccacaaggcagagcatatcaaaacatcatgctgtataccataaatacagtttttgtcaactaaaacaaattgacaaattgattttgacatataacttctgacaatgcaaagttttagaaaagccaaaacctagccttctcttcctggttcttcctgaagtcaggaaaagctgggttgagaggatgaaatataataataataataataataataataatgataaatttttattaaaagccaaaaccccttctaacagaaacctttgaagtagttttccagtaccaaaaactgacctcaaattaacagagcagcctaccttccatccttccggggaggtgtttagcagagtcgtggtaaactccataatccggaccacaacggtgcatttgctgtagttgtacctttctccctcttgtgggcttgttctgttacctgctgccccagtgccaaagcacttttctgctgctataatgtcatgcatggcaatgctttctaagaagaaagccactgctttcaaaagtgaagactgggcttcagtacctagaagcaattatattaaagtattaatatatgcttcctttcaactccactaagattaacataaaattgcttctgtaagtataggcatggtatacgttcagcaaaaattcaaaatttttcaaaagaaacaaacagcttaataatagctgaataaagtggcatttattttttctcatatcaaaggacacattgatggaaagtcaggtctttattcccaaacattacatgtgagaagataaattaatatgctcattttaaagggcaatttggcaattcgtaccaagtttttaaaaatatgcatgccaatttctatcaaatgtttaaaaactcattatgctttgatccagcactgaaattttaacctaatgaaatgactgcagaattgaagagatgtggttgtaagaatcttctttttagcactgttatcaataatgaatgttattaataatgaaaaaataaaaaatcctgtccttcaaaggacagagacaaattatggagcagtcttcaagcaggtgtggacaggcaccagtcatcttatggaatcaactttcagatcaatcctcaaacgggctttgtcataaaactcgtttgtctgaaaacaccctggagcttgttctcctttcccatctcaggttgttcatcaggactctcctgcttaatgaaagacagacccaccctcacctctctccagtctaactgtagtttattactccaaggtgcacagccctttagagtgccaagggacaatttaaaatacttgtacactgttgaaagagtaaaggcaacaattgagtaggaaagcctttttgtaagtctcatggtttctaattctttgtttccaacataatttaaggaaagtcaatccaaactgtcaactgacctcgttaaaaataattttgataacatgtattttgatgtattccaagaactgagataacttatattaagaattattctcagccgggcgcggtggctcacacctgtaatcccagcactttgggaggccgaggcaggcggatcacgaggtcaggagatcgagaccatcctggctaacacagtgaaaccccgtctctactaaaaatacaaaaaattagctgggcgtggtggcgggcacctgtagtcccagctactagggaggctgaggcaggagaatggcatgatcccgggaggatgagcttgcagtgagccaagatcgcgccactgcactccagcctgggcgacggagactccatttcaaaaaagaaaaaaactaattattctcaaaaaccaaatatccttgaatccaatagaatattggattgtaagacacactgcaaccatggatctgttaaatatgggaaaatgtacattttagaataaaccaaatatggcacttatttatgtgaacaagttttttttgttttggttttattttctgagacggtgtcacccaggctggagtgctctggtgcgatctcagctcactgcaacctccgcctccggggttcaaacaattcttgtgcctcagcctcccgagtagctgggattaacagggacctgccaccatgcctgactaatttttgtatttttggtagatacgggatttcgccatgttggccagactggtttcgaactcctcacctcaggtgatgtgcccatctcggcctcccaaattgctgggattacaggtgtgagccaccgcgtccggccatgaacaagtttttttaatactaaaatctatacgtacaaaaataaaattccaaccgcataattttacattttatgtgtaataattaccaaaatttttattatatttgttgttgtggcagtaaaaaatgtaatgtgcactaataacaaatataatagtaacacagaagaaaattttttttgagacacggtctcactctatcgcccaggctagagtacagtggcacaatcacggctcactgtagcctcaaccttccaggctcaagcgatcctcccacctcagactccccagtagctgggatcacagatgtgcatcaccacgcctgactaactttagtattttttgtacagatagtgtctcgccgtgttgcccaggctggtctcaacctcctgggctcaagtggtcctcctgcctcggcttcccaaagtgctgggattacaggagagagcctctgcacccagccaaggaatctttaaatatgtacatcttttcattaaaaagacgtagatagggatatagtaaaatcttaagcaaaaaaaacttaatactttaggataaaatcatttgaagggtaggaaatgagaatatgaattaagggactctgcaaaatttccaataaagcagctatattttaaagccaatgatgctgtacataaaactgctacagtattcattgttcatggaatacgttttttttaagtaatattaacagttttgtgtatttaaaatgtcaacatttacaatacaccagaaagtgtaactttttcaattatataaagctatgagaacactgtatttgtcaactttgaagtgtgaagaatggaacccttgcagagaagtgacatgaaagcacgggcaaggtggtgcacagcacctaccatcatgtcgctgggattctgacctggcagagccactgcccagggtgactctggcagcacgacacacaccagaataaggcaagggtgacctacctaggacctggagcgctcctacagttctctcgccaatgaacgtgttgtagcactccaacgcggccaggagcaggtccagccagcatagcgtggcctgcaggctgaatggcccccgaagtacaagagggtgggctgggccaggatgcccgagggctggccacagccacccccctcaaaggtgttgatgagaaaagagacaccttcttccttgagaacatctttcagccacaaattaggggatctgttgcctttaaaaagaaacaaaattaaaatgcacacatatacctacatttctttaatctaatctttgtacctaaaatttcaaaatgttatgggacaatcttttttcattttactacgcattcaacttgtttcactgtaattacttccaagaaggtatttccaccacagccattctcttcaggttcctcaaacattataaaaatagttggacaccatttggagtagctgcatactaatactctttcccctgcctttttatttaaaaattattattcctttaagtcacaaaacagcatttgcaaatgagaacaataatatctacctctggggctgttacaaaaattagctgaattaaagtagttaatatttgaacatgtgcttagaataacgtctaccacacagtaagtgcagtgtttgttaaataagagaatcgaatgagccgttttttccaggaaattttcttttaaatattaaacttcttctaaattaaaaagataaatacataaaactgcattttgtatgctctgaaatcagtagcactgaaaatgtcaaatcattctgactctaatgaagaattcaaaacatgtatctctgatgtattaaaaacagaacattcagccgggggtggtggctcaggtctgtaatcccagcactttggggggctgagatgggcggatcacttgaggtcaagagttcatgaccagcctggccaacatggtgaaaccccatctctactaaaaatacaaaaatcagccaggcgtggtggtgcgcgcctgtggtctcagctactcaggaggctgaggcaggagaatcgcttaaacgagggggaggttgcagtgagccaagatcacgccactgcattacatcctcagctacagagtgagactcggtataaaaaaaagaaagaaagagagaacattttgtatattaagaggaggaatattctgtaatgttctgttactttcactaagagacaaagaaatgtataataatgagcaaaaaataaatagtaagatatttaaattctacatcaagagtgacagaagaaaaatgatagaaagaaaggacacaaaaaggcagatcgagagagagcagacaagggtacatcacaagaagacagagaagctgaagacgcagacaagcacgcttggggttggggagcctgcccagccctacttcttccttggtctccaccgaggacctgctgtctgtttctgggcctggaccacgctgagtctcagtattcagaagccgccaggagctgtctctcttggacacatgtcagagggacaaccctgcacctgtcgtcaagccctactgatctgggtgttcctgtacccaggactgctgctacacagtgagctaaagagacacctgacacagacgcttaaaaaccactgaaggaagctagatgcaatggcttgtacctgtaattccagcactttgggaagccaaggcaggaggactgcttggggtcaggactcaagactagcctgggcaacatattaataccaagaccctatctctacaaaaaaacttaaaaatgagccaggcctggtagcacatgcctgtgttcccagctactcatgaggctggggcaggaggatcacttaagctcagtttatggctgcagtgaactataatcatgtcactgcaacctacctagcctgggcaacagagtgagaccctgtctcttaaaaacaaacaggtgctgcacacctgcagtcccagctactaaggaggttgaggcaagaggatcacatgagcctaggagttcgtgtccagcccggacaacatagtgagactttgtctctaaaactgaaaaggaaaaaaataaaagaaaacaaaaatagccactggaggataaagataccaaaggagaaaggtggctacaccctgcaaggccacagaagagataaatcaaggaaggctccttaatgttatacaaattacctgttggaagaagggcaaggctcacctactacctagcagcctttgtccaacaaaacacaatgctgagaggtggaactctatttagttcagaatacatgaggtccgtatcacaggcaactgagaagagaacagcactagaaatgcctgagatcagtacagctgaggtcacaagaaatcctatgtgctaccagagtcacagactcaatgtgagatagtggtctgcccataagcagctctaccaacatgctatcagggtctcggtttctactaaatataggaaaaatgctgcccactgccctccagcccttccccagccactggtccactcttcaatgactaatttcacaaggttgctgtgagaatgacttaacatataaaaaaaaaagttgttagctaaacacattaagcaaactgaaaatgctaggccaggcgtggtagctcacacctgcaatcccagcactttgggaggcagaggctggcagattacgaggtcaggagtttgagaccagactggccaacatggtgaaaccccgtctctactaaaaacacaaaaattagccgggcgtggtagcacacgcctgtaatcccagctactctggaggatgaggcaggagaattgcttgaacccagggcgcagaggctgcagtgagccaagatcgtgccattgcactctagcccaggcgacagagcaagactctgtctcgggggaaaaaaaatttttttaaatgctaatgttttttaaacaattatctaaattaaaacacagatatacatttctattatacatgtaaaatgatatagtaaatttatacttcattatttatatagcatatataaaataatctaattcagttatagtatgtatttatacatactctatagtatataatatgtagtatataacattataatatatcctatagtatgacaaaatgtaaagtcctttttagttttagaagcctggaaatatataaagtaacttttttcctcttgttccatgaagaaaaagcccagacagaactccaccccaggccaggtgcagtggctgacgcctgtaatcccagcactttgggaggccaaggcgggtggatcacgaggtcagcagatagagaccatcctggctaacacggtgaaaccccgtctctactaaaaatacaaaaaattagccggacgcggtggcgggtgcctgtagtcccagctacttgggaggatgaggcaagagaacggcgtgaacccaggaggtggagcttgcagtgagctgagatagcgccactgcagtccagcctgggcaaaagagcgagactccgtctcaaaaaaaaaaaaaaaaaaactccaccccaacttttgccaaggaaccagcacacccatctaacctgaggcactctccacacatggcacagggctgtgacagcccacaatgggggaaggcagggcttgatctgtcctgagcacagcttccccactcccaagctatcaaacctaggtttggacttaatggacaaaactgagcaatacatttattcctgagaaacttgtcattatttcagtccataagcagtttaatggtttagtaattactgaaaagcacaggttcactgctttcctttaatatgatttgagatcattcagacttaggatgctggcaatttcttattaatcacatgctgaaacagaactgcattacctcatcaactgttaatattctgaatcttaactgaataccatgttaactgcaatgatacccaattactcaattcttctttacttcttttaaatgggataataaagcaccgtggtgaaattaaagatatacagattaccatacctggcaataaaggaacgaatttataaaagagttcaatggatttgtgtcgacattctgtctggggcctcccacaatgagctaaaagccacttgaccagatccaataaacacaatgatgcggaaggtggaaatcctctgcacagagacagcatactgtcattagtccctctccaacatgcaacattcagctaccaaggctctagaaatcataaactcatctttatcacacagatatatgtagaaatctcactaaaaggcattcgacttatttttaatgtattataattagatgcaatcaaaataacataggtgaaatgggtcctaaatgctgctcatgttcattttttcatgtggggaaaaattaaaaagttctccttaaaagaacagcactaagtattttcatgtttcctttgcaatataccttgtaaagcagtgcttctcaaagtgtggtccctggacagctgttccaacattacctgtgcacttgttataaatccaaattatctggccctaccccaggggtacacagaaattgagggtggggccagcccagcaatctgtgttttaactagatctccaggcaattctaatgtatgctaaagttagaaccaatgaactaaactgatatcgtaagttaatagtagaatctggaagaatcaacttttaaaacaactgagaaaatattaataatccagtccacatgggactgtgcttctccagagtggcggtcactagcatggataacagatgtccccagataccctgcagagatctggaggggcttatggagggcactcaccctactggagaaggcaacaccactaggatggaataagggcaaaaactggaaaccactggccaacatcccagccttggttggctctaagcagtttcatttcctaattttataattccatgtctgtcaaaatgttactatttgaacattcagttcatacacttcaaaatttacggaataatggttcatgcatattctagtcaaatcatccacatcaaaacatgttcaaaattagtgcatattaaataaaacgtctgttacaaaactaattttcaatttgtatgtactatctcaacccagatcaaataccttataccttatcccttaaaccaagtattttcaaacacaaagctttttaacgtttttggaaaacgaactcttcagacttccacacattccttgtttaggaagtaattccttatacttccacagatccatcccaggttgtccttcattagctgtgaattagttttatgttgtgggaaaagacggaaaaggaagcaagatcacctaccgcggcaaacgtcgtttctttgctttatttaaagaaacatgcttcttttcaatgatgcggcataggtgatcaatggcatcacaacactgttgaattgtacctgttctcaagtacagagacatatttccaaagaaggcatatatagctgattattattaaatttgtattataaatgtgttggcctaatttttaactgaaaaggtaattttactatagatttaatatgttttcatccctaagaataataaaattagataaatgattcacactgcatattcaaaaatgaacacaaaacccctatttaagactgcaggatagcatggtgcgtgcacgcacaaacacatgcacacactcagagcaatgccatacctaactagaaactgtaccaccaacaccacggccacccaaagcacagcctctcctaatggacctgagatggaagagactttgcaggtattacaaaacccacataccaggccagagcctgtggacttcaatgtggctattttaaaggggtgtaaatcccttgacctcccttcctatgcaggataaactacggtatcgtttggtaatacagcctctggagaagtacaacagaggtaagatggtgaagtcactcacagaagtctggaattatttaggaaaggagccttatacatcttattttgacctgtgtcaccaagaaaaagttttctatgttttttaaatatgtccgtgatcacaaaaaaagtttcactcgttgaaaaaattcacccatatgggaaatcaagataaacaaagcaaatttaagcaatttgacaatgaggactaaattttacacatttttgcccacagtagactatcaacatgaaggataacagagctcagtctgtctttttaaaaaataaacaaagttgccaggcgcagtggctcatgcctgtaatcccagcattttgggaggctgaggcaggtggatcacgtaaggtcaggagttatagaccagccaggctaacatggagaaacatctctactaaaaatacaaaaattagccaggcgtggtggcaggtccctgtagtctcagctactcgggaggctgaggcaggagaatcgcttgaacccaggaggcggaggttgcagtgagctgagatcgcaccactgcactccagcctgggtgacaagagcaaaaccccatcacaaaaaataaacaaataaaataaaataagtcaagacccgtatcagtgataaactcctgccacagctgtgtggccgtctcagtcaatgacacgcctgagcctctgtgccccaactacatcatgtgctgggaccaacggggagttaagaagtcttctagctcaacaactctatgtagttcctaatagcttcttgcatagaatttaattgtaatcatttattactctcttagctattttagcctacttctgacttaatatctttataatattccttcatcatggatgaaacaactctatcacagtcctgtaatgagatccactttctactttctaaatgatcacgagtgagtgcagaggcactgaccacatctcagtggttaccacatccagtttcttcagcaccatatctgcacagtttcatgttctgtcatcacagcatcatagtgtctgactggcttcgttgtctcccctgccctgggcagaatctgcaaccaaccagggtcaacctcaatggccaccaggagtacatggtgagtcaaagaaaataagggcatgaaaaaattattaacaagctgggtttgaggcactgaaggggattctcttcacatttattaatttatagaactcttgggaaaaaaaaaaccttataagagaatcacacgagccttaactcctcattggggaaactcttcagacctgtaacgcacacagaacactgaagcaaaacgtacctaaggacttctcatctgcatgtgctaaggccagactctccatgtatatcaccaaggcttcaaacacaaactgttccaccagagactcttcttccctgtaaaataaagaataggaaacctcacctaagaaaacaataaagcagaaaggacaaagaaaagaaggaatggaattaaagaaggcacacattaattaaatttgttttttgtggccgggtgcggtggctcacgcctgtaatcccagcactttgggaggccgaggcaggtggatcacgaggtcaggagatcgagaccacagtgaaaccccgtctctactaaaaatacaaaaaattagctgggcgcggtggcaggcgcctgtagccccagctactcgggaggctgaggcaggagaatggcatgaacccgggaggtggagcttgcagtgagccgagatcctgccactgcactccagcctgggcaacagagcaagactccagctcaaaaaaaaaaaaaattgtttttttgttgttgtttttttaaaggctcagctgggtgtggtggtgcatgcctataaagatcacttgagccctggagttcgagaccagcctgggcaacaaagtgacaccctgtctctacaaaaaattaaaaaaaaaaaattagttgggtgcagtggtgcacacctgtggtcccagctacctgggaggctgaggcaggaggaccacttgagctcaggaggttgaggttgagtcatgatccccccactgcactccagcctgagcaacagagcaagaccctgtctcagacgaaaaaaagggcggggtgggggggctctgtcttaaaacatgaaacaggtgcagtggctcacacctgtaatcctagaactttgggaggctgaggcagggatcacctgaggtcaggagttcaagaccagcttgactaacatggtgaaacccagtctctactaaaaacacaaaaattagccatgcgtagtggcgggcgcctgtaatcccacctacttggaagactgaggcaggcaaatcgcttgaacctgggaagcagaggttgcagtgagccgagatcgcaccactgcactccagcctgggtgacagagcaagactctgtctccaaaaacaaaaacaaaaaaaaatagaaaagaaaaaccatgaaacaacctaaaacacttctcaaagatacttcctcaagagcagactagaggaaagctacatgagccaaagaggcagcacacgctctgtttccacacaagtgcctctgtcccttgcatctgcagaactgctcatttgcctatgtggctaattattatctatgtgtccttctgaaatgtaaccctcacgaagggctgtatcgttatacctccaacatagacacaggtctggcacatcattttttttttcttcatcttttaagttcaggggtacatgtgcaggatgtgaggttacacaggtaaatgtggtacacaatattcctaataaggaatgctggatgaatgaatgaacaccactaccttaggtcagtgaccacttgtcttttaccttggacctctgaaatggcctgttcactggtgttccagtcttcagtctactcagacccactctctacacagctaccagcaagtggattttaggaggaaatctaaatgcatctctccctgcacccactactccacagatcctctgtcactagcggtgacctacgctccttactacagcaagcagagccctcctcgccagcctcacgacacctgcctccaaacctcaaaggactttatcgcctcagacaccttcctatttcttatctctacccccccaccacccactaactttgatctaaaatgccttggctgacttccatttatccttcaagtctcatctccaatataaaccctagcaagaggccacagcaaacttgctcaccctggatcagctactcctcctctgtgcacccaaagcccctgtatatgtgtcttttgttgcatttccaaaatggctgagacagtgtttacatgcatttctcagcagtttccaagcttctggagtgcaaactgaattttaattcactttttaatttccagaagacagcacagcatccagcacataattacttactaaatgcaggaaatatgacacacggatacacagagtgaaactccaagtcacctttcaaaaccacaagtttctcttctctgttgtgtagcttacaaacctgaattccctgtagatattattaaaggcaagtgatgctcccagcctcttgaaagcattggggtgaagcgcaaggctataaagtcgcttgaaaagcgatttggtgtttactggactcttctcctgctgctgtggtgttatttgcttaatggaccatttaaggaattctcgaatacaccgaccacaaaaatctcttaaagtactgtcaacagggtccacaattccatcctgaaacaaaacaaagagaccttgattgtactaatttttataaccactgacaactgaatacccttggtctatctctgagcataactaaagtatgttaaaaattaatttatagcactagtcaagaaaaaaataaacattagtaaaaccaatctccatagtgtatccagaatctaggcttgaataactatttccttctgatataatgaaaacattttcttttaaacaaattaataaactgaaaagccatgaagaggggagagaaaactttaattataacaaaacaatctttcccttccctgaaaaaaaagaaaatggctatatcctaagaattccagaggaattttgattgttgattttaccccataacagcttttgagacactttgcatattgaagtcaaagagaataagaccctttgaagttccaaagaaactgtactgctccataaaggaaaatcctatggaggcatgaagagcagaccccataaaggccctgccgaaaacagctatggacatttgaccaacgaccacacagagatgtattctactttatgctttgttgccttctagtcatgacgctgtctcagatctacaaaggaaaagtttaacttgaaaacgtacactcaacaatgaattaagagagttctgcctaacacttccagttatctgctacatataaaatcctttcttgcagaggtaattagaatccaaaaaggtaacacaagccatggtaatgggaggagagggtgcttcctgcttttcagagcagaggtcaccagcgccaagtggtgatgcagggaagagcagctctcaccaggaaacccacggccctccttcacttgagtgccgtgctaccgagttcatgctgcttctttaccttttctttcctcaactatctcgttttacttatcagatttctttcttaatctcttacttaatctaccttcaaggatcaaaagggagaaaagaaacagaaaacaactaaaataaaaactttttaacagaaacattataatgaaaacatctgaatgtaaataagccataaattaactttagctaactgtatttattataggtaggattcactggtagacactgcagggaattaaactacaggtttaattatgtcaccaccctaacgaatgttcagtcactctcccctacccgtaacatgactaagaaagatcacactcagagtacactgccagcagcataaccagggctgtgcaggagacataaacttatttgcacaggttcaaaatttatagtaaaataagcatcaaaaaaaaactacaatttagctggcctcactgcctctgccctcagtgagctggcgaccaaattctaagacaatgcttctccgtgtcaggagagttctgtgtaaaaggtgaactgctgtttccagggccctttagttattgaatctgagtataggagaaaattggatatactcagaaattcttcttattctttgtttttgagacagagtctcactctgtcgcccagactggagtgcagtagcgcaatctcagctcactgcaacctttgtctcccaggttgaagcaattctcatgcctaagccacctggcgagctggcactacaggtgtgtaacaccatgccagctaatttttctatttttagtagagacagggtttctccatgttggcctggttggtttccaactcctgggctcatgcaatctgcatgcctcggcctcccaaagtgttggattacaggcgtgagccactgtgcctggctcactgccaaggtgggcggatcacttgaggtcaggactaagaccagcctggccaacaaagtgaaacgctgtctctgattgaaatacaaaaaattaggcaggcatggtggtgtgcacctgtagtcccagctattcaggaggctgagacaggagaattgcttgatcctgggaggcgcaggttgcagtgagccaagatcgtgccactgcattccagcctgggcgacggagcaagactgtctcaaaaacataaataaataaacaaacatcaaatacaactaatcgatgggagtaagaggaaaagaatcaactattacttaccaatatagcttctagtaaggcaacagtatcctgactttcaaatttcttgttgttagtgaaccagtgaatcagctgcataactagtggctcatacagttgccttgtcacctgaagaaacaataccattaaagttaattcccttcatgttaaagaaatgttacgctgtaaagggttccatttaaatgccatttgcagtataaaattaagtaatactactaccatggttgtattagtttccttttttagttcaggctcaagtggtcccctcccacctcaacctccagaatagctggactacaggcatgtaccaccacacccagttaacttaaaattttttttttgtagagacagggttccactatgttgcctaggttggccttgaactcctggcctcaagtgatcctcctgcctcagcctcccaacgtgcagggattacaggtatgagccaccatccccagccccattagtttccttttccagttaaattccatgatgaagagtccagcaaagaaaaatatgcaacaaaagctcattgttcctctgattgggagggcaatttaggatacatattgttggctttgtaatactcatctttattcatttgatcttgaacgtgcacacaagatatcctggattacagacaatctagtcgctattcaactattgtacaaagcaaataacaaccctgtggttccccacagcctaactgtctccccttgtggtgacaaaatgaaacccaatcaatgtcctatatacacaaattcaaagccagtaccacaggggaggaacatagaaaaacagatttaatctgtttatatacaggacaaagaggaagctgcctctcccactgctgccaaaaggagggaggaaaacctctatggagataggatgaaaaggatcctaggtctaatcttctggaacataaataaagcctctccaggggccaggtagccccgtgctccctggctttgtaaaatccaagatgtctccaggtctgggctcctcccttatgacaagtaaatccatacccaagaaggcagagctcctgtcttcctggaggcttggaagtgtaacctagtggcctggtggaggtgtgaccatgtggccatcttggagcaaaaagagaagtggatcagagcaattagctagataaactgctacagatctaaccctcattatacatgagagtaaaatgctggccaggcgcagtggttcatgcccataatcccagcattttgagaggccaagtcgggagggtcttttgaagccacttcaagaccatcctgggcaacataggaagaccttgtctctcaaaaaattattttttaactagctaggcacggtggtgcgtgcctgtagtcccagctactcaggaggctgagatgggtggatggcttgggcccaggaggtggaggctttagggaactatgactgcactactgcactccagcatgagtgacagagggacaccgtgtctaaaaaaaaaattaaaatggccaggcacgatgtaatcccagcactttgggaggctgaggagggcggatcacttgaggtcaggagtttgtgaccactctggccaaaacagtgaaacctcttcactaataaaaatccaaaaattagccgggtgtggtggtggtcacctgtaaccccagctacttgggaggctaaagcaggaaaatcgcttgaactgggaggtggaggttgcagtgagccgagatcgtcccactgcactccagacacagtgagattccgtcaaaaaaaaaaaaagtaaaatgcttgtggtggaagttaaggtgaacactccctacactgatatcctgtacatttctgcctcagaggccagggcttttataggagtactgagccatccaggagacctttattccccacggttattgagctcaacaattaagtactttgatattagaggtccatactgtagttaatatcacctcaaaaatgatgcaaaatgtcccagggctcagactaaacaacacagagactcttccaaacagtctttctagtctttgaagctatttttttcccctaataccttcactggcctctatgaagcaatttttaaaattaatcaatataaaagggtcttaactttcagtttgaaagtttaacctggtcttaaagcatcacttttttttccacaaaagaatcatactggtgttttttttttgagacggagtctcgctctgtcgcccaggctggagtgcagtggcgcgcagtctctgctcactgcaagctccgcctcccgggtccacgccattctcctgcctcagcctcccgagtagctgggactacaggcacccgccaccacgcccggctaattttctgtacctttagtagagacagggtttcaccgtgttagccaggatggtcttgatctcctgaccttgtgatccacccacctcggcctcccaaagtgctgggattacaggcgtgagccaccgcgcctggccaagaatcatactgttttattcttagtacataagttttttaatacatgtatacatagctatatatatatatatacacacacacacacacacacacacacaatacagacatacccctttatagaaaatcatccctctacaatcctacatcccaaaggtaaccactgtcgactttcaaaatattttatttatatacctttttttttttttttttttgagacagagtcttactctgtcacccaggctagagcgcagtggtgaaatctgggctcactgcgacctctgactcccgggttcaagtgattctcctgtctcagcctcccaagtagctgggattacaggcgtccaccaccacgcccggctaatttttgtatttttagtagcaacagggtttcaccatgttggccgggctggtctcaaactcctgacccccggccaatttatatacatttaaatatgtgtatatacacgtgtaaaaataaaaataaatctgccaaggaggcagagctcctgtcttcctggaagaaaccagtaactggtttcttcttagagtactttccacgtaaacatatgcactctaccaatgttttcagtagccacccagtacctcaactatggaccacaaccaagctaccagaaccctacagctagaaatgcaagtatttctaaattatgactaccatacagagtggagagtcctgagcacactgtttaagcagctctcttgtaaggaagctgctaggccaggactgtggtcactcaatccgagcccagctgcagagcactgtgcctgtgtcgccccaccaaccatgacacgcagggtcctttccttgtgcccttggcaacaccaaacattgttcatcttttaaatatttgacagtagccaatatcattttaatttgaagttccttgtttacaaaacggttgactattttaagatacattccatcggccatttacatttcttcttttatgagctgcctatttttttctttatacatttgtccattttaaaatctgatctcttcagtagtatgttgcacattatacatgttacaatgttggttttgtgccattcagtagtcttaaacatttataaggtcaaaactatcaatacattaacacttttatgtgtctccctatctgtacaaactttatagaaagacacagaaggatgctgattatagaaaagtaatgaaatccatccaaggagcagaaatcacactgcacacagaagaaaacgttttgaaatgctacgagtctactttttgttaacaaaacatctatgcacatgtcaagatgtgttattataaagacattctccagactttacagaggatctaacatcttttcccagggaacaagcaggtgaaaggggtgacgtgaacgttcatttttatctttgaacattttaatattataaactgatgtgttatcaacaaaaaagacctaaagatatacacagacagatatgctatgtggtcattacatttttctgtaatttatttatagttcgtttttccttctaaatcttattgatttacagttagtttcttcacttgtgacaaagcccctcttccttaccctaactctagtcaggctcctctgaactcttctcaactaggccttgatttctgggcttccatgttcatctctattagtccagtttcaccaagaactccgctgagtcagttcagtgaaaactcctccccttgatatataatctaattcctcatctccccccagcccccaggcagtgtctggtcaccctggcccatcttcagccataacactcttaggattggtttagccacaatcctctttatgcctgatgtttcttctgttgtgggaagtcagggaccccacacggagggaccggttggagccgaggcagaagaacgtaaattgtgaagatttcatggacatttatcagttcccaaaattaatacttttataatttcttacacctctctttactgcagtctctgaacataaattgtgaagatttcatggacattcatcacttccccaatcaatactcttataatttcttatgcctgtctttaatctcttaatcctgttatcttcgtaagctgagaatgtacatcacctcaggaccactaccgtacaaattgattgtaaaatatgtgtgcttgaacaatatgaaatcagtgcacactgaaaaagaacagaataacagcgattttcaggtaacaagcaagggaagataaccataaggtctgactgcctacagggtcaggcagaacacagccacagttttcttctcatagaaagcctatagacggatgtgcaagtaggagaaatatcgctgaattcttttcccagcaaggaatgaccctggggaaggaatgcattcctaggggtaggtctatagacagctgctctgggagtgtctgtcttatgcagttgagataaggactgaaatatggccttgtctcctgcagtaccctcaggcttaccaggattgggaaattccagcctggtaaattctagtcagattggttgtctgccctcgaaccctgtttcctgttaagatgtttatcaagacaatccacagtgggacataggccctcatcagtaattctaattttgccttgccttgtgacctttattgccctctgaagcacgtgatctttgtgacctactcccagttcatatacccgctcctcttttaaaatccctaataaaaatctgctggttttgcggctcggggttgtcatcacggtcccgggtgtaacatttctctctttgtactctttctctttatttctcagaccggccgacacttagggaaaatagaaaagaacctacgttgaaatactgggggctggttcccccaatattcctcttagttattttccatccactgaccctgaccctgctccttggctatcaatccccctggtcaataagtatttggagtagagcccaatccctctacagcagtgtaaaggcccactggagtagcctcccctttaatagttttccttaacatcttaacgaatgtcatgaataactttttctttaacatgttagtcatttgacctaataccatttattaaatgacccatttcccacttaaataaccccctaccatagacacaattttcatatacacacaaggggccatttcccagcacctagctctcccactgagccatctgtgcgctggttcagcctcttatactccataaggccacttttcaacatctactacacaagactccctccagcgtgcaaccctttcaaaatgtgtcttgcttattaggctcaagcaattactccttcagattattcttttaagttcaaaaataaaattaattctggattttttactggaattacaccagagttatcaattgatttggggaaacgacgtttttttcaataatgacttctacctcaggtacataagctattcatcttctatagtcataaaatatgtttgcctggcacattgaagtttattcctagacattttttttttgatgctgttatgaataagatgtttatagacatattttccaagtggtcaatactaatatatgaaatatatgagaataatatatgaaaaaagatatatgagaattatgtgtttataattcatcagctttttcctttattaattcttagagtttatcagctgatatgcttactcttgggccttccagattttgaaaacaattataataatcttttctccttcttaatagtccttctatgattttcttatcttacagtattgaatagaatctcccaaatagttagtggggctgatatcctagccttactggcccgctgacaagtgtcttttgattgccaagtgccaagtgctggggtagatgctggagaggaagcaaggaacaccaggctctgtccatgcagagtttaactaactccaagtaaagcactgaccactcccagaaacaggccatgctcccatgctgggtggaagcacaagggagtgtcagtgcttcacacagaggatgacctggctgcaagattcaggcagacattctatcacattaaacatcatgtgaaactactcctagtttatcaggagctgccaaatgccttccaggcttccatggagaggttcattgctacgttaaatctatttctgtggtaagtttccagttttcactatgagctctatttaatcacagtgcatctgaacatactgctggactatatccactcatgtatactgcagaattttccagctgcattttgaatgagttttgcatttcattttcttttttaagtgtgtaccctgatatccaggtcatgctagattcataaaatgaactgagaagatttcttacctttttctgcttcatggcagcagtgaaggatttgtccataaagtcatagtataggccacttgccagccatagctattttttatttatttatttatttttttttttgagaatgagtctcactctgtctcccaaactagagtgcagtggcgtgatctcagagcactgcaatctccacctcctgggttcaagtgattctcatgcctcagcctctcaagtagctgggattacagatgcgcaccaccacgcctagataaattttgtatttttagtagagacgggggttttatcatgttggccaggctggtcttcaactcctgacctcaggtgatccgcctacctcagcctcccaaagtgctgggattacagatgtgagccaccgcgcgcggcccatggttatttctctcttcttccctttgtgaaagactacgtttgtccatgagaggggtgacagctaattcacctttagatgcctggactctcagtaacttttaactacaacagcgattcccaaactccgagacacactgaaagtggaggggagagcttttagaagtcctggtgcccaggtcatgcccatgaccaattaaaccagagcacctggggtagcagtcagggagcagtatcgttcctaaccatctccaggtaattccactgctctgctgaccactgaattagacaaaccaaacttttagaaattttacaactatttcagattcaaagcccttacctgatcaacatcacacgcaagtcgaagcagcacaggaaacgtccgcttatagagctggtacatgggtggggctccctgtcccccttctggcatctgcgtggctttgcccaacataaacataaccatgctatgtaaaagttcacaggctgcaacctaaaacagaccaggaggtcagcaatgtttaagttatcacgttgatgacaagagaatatttgaaatgtcactcaatttagcctttaagaagaaaaatttcattgcacataactatcatgtaacccaaatataaattaactggaattaacatttcttgttctataaaactaatgattctgttcactttgtttttttatccaagaacaaagaattaaaatgtaaaagctttagaaactgggaagtatatttcactgttgccatattaaagaactatataactttgcttcatctgttagcacattttcaactatcactttaagtaaaaatattttttgaagcactatagaaaatttacaaattaatacacgcatacctcattttatggagctttggacacaatgtgttttttaacaaattgaaggtctgtggcaaccctgcattgagaaattctattggctcaattcttccaacagcatgtgctcactttgttagcatttttaagcaataaagcattttaaagtatgtatataaagttctaatgctattgcacactaaatagaccagagtatagtgtaaacataacttttacatgtactgaaaaaccaaaaaactagtgtgatttgctacactgagatattaactttattgctttggtctggagctgaacctgcagtatcaccaaggtatgctatgcctgtatgaaaatttgagattatctgtttctaatctcccagagttaaggggataaccaagcatagcccgaatatcactctcaaatgccctttatgttccattttatataatgaagagcttttggtatattaacgttttgaaaggcaattttttttttttgagacggagtctcgctctgtctcccaggctggaatccagtggcgtaatctcggcttgctgcaaccactgcctcccaggttcaaacgattctcctgcctcagcctaccgagtagctgagactacactcgcatgccagcacacctaatttttgtatttttagtaaagatcaggttttaccatgttggccaggctggtctcaaactcctgacctcaagtgatctgcctgcctcggcctcccaaagtgctgggattacaggcatgagccaccatgcccagcccaattacctattaagatgatttatacttaacttacatttatcaatgacactgacttctaataagtaagtagttttctaattactatattacagaaaatacaaaattactaatattggaatggctgaaacatgttctctatatcctaagcaatatgtatttttaaagcaataggatctaaataatgggtgaaatgaaaaatagaagtactttagtttgtctgtcactggctgtgagcgctaattctgtgactcgaggcaggaacacatccaggaaaatgacaggtttcatctctctaaagggcactgcaaagctcagccgcttctctctgtcccaggccacatagctcttcatcatctcatctgaggacgtgactgttagaaaagatttaagaagaatgaaacactttttttctttttattagtgtcagaattattcacaaatcaaaacatttctaatgccagctgttctacattctattaaagtgaagcacttcattcatctttcccttttcttttgcctcagatatgtaattacaacatcagaaatcactcgatttaatttaaagtaaaattacttttaaacaagcctaatagtctcaaatgtttaatatccaaattcagtaagagttacttaaagtattttgtagaagaaagtcaatgaacaaaatttttacttaaaaaaaaaatctctttgaaacactttccaaatacaggctctaactccctaaataaccaaaagtcactggtatatttaacaccaaatttcaaaagtaaaaatacagaggaatttttactaatcaaaaatgtagacttttggccaggcacagtggggcatggtagctcacaccagtgatcccagcactttgggaggccgaggctggtggatcacctgaggtcaggagttgaagaccagcctggccaacatggtgaaaccccatctctactaaaaatacaaaaaattagccaggcatggtggcgtctgtctgtaatcccagctattcaggagcctgaggcaggagaatcgcttgaacctgggaggcggaggttgcagtgagccaagattgtgccactgcattccagcttgggcaacagagcgaggggaaaaaaaaaaaaaaaagctgattcttttaaattaaaataatagagacagcttcttgccatgttgttgcccaagctagtctcaaactcctgagcgcaggcaatcttcccacctcagcctcccaaagtgctggaattacaggcgtgagccaccacacgcagcctactaatcaaaaatggtaattctcatttggaaaaatttctaaaaatatcataatattaacaatattggatctcaaagagattaacttggaattcccgacactaatatggaaaagagtatcaaattacattgtttcaaactggataacatgcttaacaagtcaagctagaacatatgttctaccagtatactgaattattccaattttacggatacagtcaaaccattaggcaagatattattctttataatcttatttagaaatatataaatcacatataggagcaaatattcagaatatattatgacctggatacatccaaataaaagcacaaatatatctacagaggttatttattttaaaagaagtttacctgtcagaagatttttgtttatttgtcctcctagagatccaagcatttgtactactctaattcttatttcttctaaggatattgcttcgttctgtaaatttgaacaattgtatatatgtgattacaaatgggttaaagattaaatagaagacataggaaaaaactctttgccacccacttggatgtccatttcctagaaccgcagttccaaactttttggcaggatcctttccactcttaagaaatatcaaggacccccaaagagctgttttatgtaggtcctgtttatcagtattaatgacattagaaattgaaacacagaaactatgtaaatagttaaactactaaacccattacatgttataaaaagtaactatatttttcaaacaaatgaaactctgggcaaagtggccattccacagtagtgcagatccgtttacagtgtagctcactgggagacagtttggtcctcacaccgatattgcagttggaaaaccaggcaagaaattttaaatagtctttttagctaactgtagttattcttctttgatatcacaccaaaactgaaccagcgtagtttcttaaaggttagttacaatgtcgaatctgaattcttatcatgaactctacgtactctactatgttaaaatccagtggctgatcttgcactttgagtggatttttcatccatgtataatttggaaacatcatgtattcctcatctgaaaatactggttcactggattgtgcagatattccaaatgttgacacatttcattatatatgcaaaaaatcacataagcaaatatcaccaccaatcttattagaaaaaaatcttaggctgggcgcagtggctcacacctgtatcccagcattttgggaggccaaggtgggcagatcacgaggtcaggagttcgagaccagcctttcaccaacatggtgaaagcccgtctctactaaaaataaaacaattagccaggcgtggtggcacgcacctgtaatcccagctcctcagaaggctgaggcaggagaatcgcttgaacccaggaggtggaggttgcagtgagcactccagcctgggcaacgtagcgagactccatctcaaaataaaaaaaaaaaaatctttaagtaatgagaagctatcaaacttactgcaatagttacaagttctccaaaactttacagttcacttaaaagcttaaattttatcattggcaacagattttcagaagttttcctcaaagtggcaggctcggttcattttagagaaaatgtctgcatatatccacctatgaataacctcagtgtgcctttcagttgtcatttcaataaaaattgtgtccacaaagcagtggctacttcagctcccagttcaaagcaccacacagtgctttttctccagatagctgtcacacttttctacgcaggcctgcttcaggtgcacctcctgcctcacacacggagtatttttaaaaatctgtgctcagagtcaacgctagagaatcaacagtgttctccatcataataccgtggtgcaaattaacggagtaaaaatagctttggccttgcaccctggatcccccaggggtcacagttagagaaccatagtgctaaggaacaggcattgtgtatctgtacaaaaattttggcaaagcacagtggcacacgtctgtaatcccagcatttgagaggctgaggtgggcggattgcttaaccccaggagttcaagaccagcctgggcaacaatgcaaaacccatctctacgaaaaatacaaaaattagctgggcatagtggcacatgcctgtggtcccagctactcgggtggctgaggcgggaggatcacttgagcctgggaggttgaagctgcagtgagctgagatcacaccaatgcactccaccctgggtgacaacatgagatcctgcctcaaaaaaaaattaaatcgataagaaaaaaagaaattttatttgtaaaactagagatatatttattttatcctgctgtgccataaaattataaaaacttttatgccgccatttctagtttcattctagtctctcaatcaaaagatgcccaaaataatgaggtgagaagaactgaccctagagtttgcattatcagttttagatgttaaaagtttttcaaattttaattcttacttcattccaaaaatagctattttccctattctaactcaattttctctatttacgtcatattttactatcacatcgtatggctcatctcgagaaaacttgccccaaggaattatcaccaaaaagccataaaagaacaaaaaagaaaactggaacaaactgaacctgataatatgacatatttaagatctaagcataaatgaaagtcttacatatccctggtatcagtattctgacttgcttatttaatatgaaccagtttaccttttattatccactaaatacatttgagggcaggaatgaacagaaaaacaagaccaaaaaaataaacaaaacagttaatatagtttatattttcatagctaaaaatatattaattttttttgtcaggccactcccattgcccaggctggagtgcagtggtgtgatcttgctcactacagcctcaacttcctgggcacaggtgattctcccacctcagcctcccaagtagctggggccacaggcatgcgccaccacacccagctaattttttgtattttttaatagagacagggtcttcctatgttgcccaggctgagctcaagcgatccacccacctcaccctcctaaagtgctgggattacaggtgtgcgccaccatgcctggtcaatatattaaaattatttttatattgtactctactttgtatacaaaaacaactaacattttaaatgaagatttttacttttcacaagtgttagaatctgatctctgcattatgtaaggtacagaaaatacaaaggacttcttactgatgaaaggttctttgtcttcttcagatgctttaacaccactttattaaatcctttctgggcagcccgagaaagagctgacacttcccagttattcttggtctcatctatcaatagtaaacgaaaataaatttaaaatagcactcattcattcatttaatgtacattagaggcaacaaactatattgtcaaatagaaacattaaaatcctaaattatgatttaaaaaaattaagtttctaaaacaaaaaatataaatggtggttgcttttaaacatcactgtctgccaaaaggaacatggctccttgggaagtgtctgactccagggtcgagaagagcatgaatcatctcatggagcaggagtggctcccacgcatcacactcgggccaaatctgggacaatgtgggcttcaaaaccaatcatgatggcaaaagattagacccactgaaaaaataagaatccacaaatcttactaatacagataaataaataacggggaaaattgtttcttgcagtagaacatcaactaggatgaaagaaatgatgggggtagaaaatcaccattttgcaaccatcaaagtaatacctgattcagaagaatagtcagtggatactaaaactattatggtgagcttgatgaggaacaagactatttacagtgttgaagtaccccgaataaattcctttttttttttaagcaatcataaacttacagaggatggagagtatataacttctttcctgaagcactgagggtaagtgaccgactcaacaccccactgccccgaatgcttcaatgtgtgttttccacaaggacagtctcccacacaactgccacacaaccatccaaaccagattatcaacattcactcctcagcaccactccgagttcagcattcacctaagaatgtttttaattcaggacagcatattgcacttagttgacctatctctttagtctcttttagactgaagctgttcttcagtattaccttgcatttcataatttggacatttaaaaaatcatatgccagtaatttcatacgtggtctctccatatgcatttgtctaatgttttctcatgattagactcaggttatgggaaccagttgtaacattttactatttcctttattaactgctgaattaaactttgacacatgttcattttttctctgcagagtcatagttctacaactataaagtcatttccaaaagttctgagatgtccagtgcattcactgacacagccaggtgagctgcgccgcgggagggcacctgccggtggtttaactccagcaagtcttctcttggttccagaatgaatccctggcagtgggatcttagctctgctctctctagctagttcttttcctttctataagatgttaaagagttctactctctgatgggccagagatgataagagaatccagtttttagtggttttttttttttttttttgagctccaataagttaagaatttttagttcactggaaaaaacagatctttgatatctggactattcagcattttctatgtctgttggggaacaggcccccaaatctggccataaacaaaatctctgcagcactgcgacatgttcgtgatggccatgatgtccacactgaaagttgtgggtttattagaatgagggcaaggaacacctgacccacccagggcagaaaataacttaaggcgttcctgaaccacaaacaatagcatgaggcatctgtgccttaaggacatgctcctgctacagataactagccagagcccatccctttgtttcagcccatccctttgtttcccattttagttaatctataatctatagaaacgatgcttatcactggcttgctgtcaataaatatgtgggtaaatctctgttcctggctctcagctctgaaggctgtcagccccctgattcaccactccacactctatatttctgtgtgtgtgtctttaattcctctagcgctcctgggttagggactccatgaccgagctggtgtcggctatgtctgtatctcctggtttttggctcaaattgcagaactgaaactatttactaagctctctatgtgtctttgcaagtatgtgtctataattaacaaaggcctatatctaattttgtgtataatgttctcctgtatttggggggtattgataaattagattataaagtctcttaaaggagctctgtcctgatttatacagatatgtaaattgagtattcctaaaattctccaaaaataaggaagttgaactaacagtgttttaaatgtgctagattttaaaaatcgtacagaaaacaatttgggatcatttaggaatattcacataattaaggcacatctgtggtaaagagacaagtttaatattttggtttaaataaatgtattttatctatcagtattaaatataacacgaacatgcactttattctacttgtgtttgttttccctatagttattccggctaataagctaacattacttctcataacgttttttaaaactgtggtgtaatatacataacatgaaatgtactcttttaaccatttttaggtatataattgagtggcattaattacattcacaatgttgtccaaccatcaccacatccatctccagaaatttttcaacatctgaaacagtcccatacaacttttaagattatgaaaaatgtggctgggcacgggtggctcacgcctgtaatcccagcactttgggaggccgaggggggcggatcacgaggtcaggagatctagactatcctggataacatggtgaaacccccatctctactaaaaatacaaaaaaattagccaggcgtggtggcgggcacctgtattcccagctactcgggaggctgcggcaggagaatggcgtgaacccaggaggtggagcttgcagtgagccaagatcacgccactgcgctccagcctgggcgacagagcgagactccatctcaaaaaaaaaagaaaaaaaaatgaaaaatgtaataagtttatgtccaactaaattgaatcattatctgggtaaactttttatttcccaagtaattacgttgtgcagcatgccaactggaagataatctctattatctttaggcaatttgcaaccttggactgactgagttaatggatactttggatggttgggtactttgataatttctaaggaaaatattaatagaatactgaaatactgatgaaaaggcacaatttttgtgtttatgtgcttttcctttttgcttttataggccgttgaaggtaggagccttgggtcatgctaacaggcacgtgcatgctgtctcttggggggctgcagacagtggtatctgtgagctccatgagtctgacatactgctggtgtgtaaggcaattctcaatttcccactccagttttctacgtgaaacatgagtttagtaattatataattaacaagtggttgtgtggctatattagaagaatagtacagaaatacaattgcatgcatgcttttgattttctttttgagacagagtcttgctctgtcacccaggctggagtgcagtggcacaatctccactcactgcaacctccacctcctgggttcaaacaattctgcctcagcctcccgagtagccgggattacaggtgtgtgccaccacacccagataatttttgtatttttagtagagccagggttttgccatgttggccaggttggtctcgaactcatgacttcacgtgatctgcctacctcggcctccctaagtgctgggattacaggcgtgagccactgcacccagcctgatttttcatttttcttggattacaggtgtgagccacagcacccagcctgatttttcttttttctttcttcagaagggtctcactctgtcacccaggctatggtgcagtggtgcaatcatgacttattgcagccttgacctcccaggcttgagcaatcctcccacctcagcctcccaagtagctgaaaccacaggcgtataccaccacatccagctaatttttaaaatttttgtaacgaaattagccaggtgcagtggtgcgcacctgtaatcccagccacttgggaagctgaggcaggagaactgcttgaacccgggaggcggaggttgcagtgagccaagatcacgcaactgcactccagcctgggtaacagagcgatatttcgtctcaaaaaaaaaaaaattgtaaagataaggtctccttatgttgcccagactggtctcgaactcctggccttaagtgatcctcatccctcggtcaatcaaaatggtacgtgggattacaggtgtgagccactgcacccagcctgcttttcatttttaagtaaggagggtagttcctcataaaacagtgaatctcagacattttcatgtctggatctctttccagaattaggactgaccccataaatctttgttttgtgggttagaactagtagcagttactatattggaaacagaaataatgttttaaagacttattgattgatttggaggtcatgttaacatgcataacatctctgtatttcaatgagaagagttctgatctcccagacaccctgggaactggtgtttgaaagttgtgtcaattggtttcagaatatgaaaggacattaacacaggacaaatctcggaaagcgactatctgagcctaaaaagatagtatgagatgagttaaatttttagcaaaggtcacttaatcttgaaaagtttgcttctttggtttactgatcaaggactttgcctgtaccatgagaagtcattctttttttttttttttgagatgaagtctcactctgtcgcccaggctggagtgcaacggcgtgatctcggctcactgcaacctctgcctcccgggttcaagtggttctctggtctcagcctcccaagtagctgggattacaggtgtgcgccatcatgccaggctaattttttttctttttagtagagacacggtttcaccatgtttgccaggctggtctcaaactcctgacctcaggtgatccacccaagttatgggattacaggcgtgagccactgtgtgcagccaagaaatcattctatgtaatctgccaagacagcaaagattcactgtcttaccagaaaaattttctgagctttacactgacttcactgtctgaaaaaggagattcaggccatgtgtctttgacagaagaggcccagagtggcactgagttcccctcagcaagtcacatcaggatgcacgtgtggcccacaagtcctactgctagtcagtgggcaaagaagggctctaccaggtgtctatgctgtaaaatcaccattttcactctcaatcattagtacgtgtttggctgaggtactttaaaaccatggtacttcaaaaagtgccatgctggctgtgaaggtgtaggggccacctaggaggacactcagaggcctccaggaattgagaatcatgctccagccgtcagtcagcaaggagacaggaaccttggtcctccaatcacatggaactgaatcctgccaacaacctagatggggagtgaacaagcctggactagccaacaccttgaattcagtcacatgacttaacagagaacccagctgagcccatttggacttgtgtcctacaaatctacgaaataatcaatgggtgctaatttaagctaagtttataagaacttattacacaccaaacaatcaaacaaaaaaaaccactaggaaactttaacttactcattttacttatttatatctgcacatgctcactgcttcctatttgattacctgggttataacgtttctaaagttatttattttgatgctcaagtcatcactacttttgcctgtgacatttcccccatcatgctttgaataggtccttactttccggatgttctataaaatacagtattctaagttcataatatattttcccggccccaggttggaaccaaggagtcctggttccattaatggaaaatgaggtgtgggtctgggcatggtagctcatgcctgtaaccccagcactttgggaggccgaggtgggcagatgacttgaggtcaggagttcgagaccagtctggtcaacatagtgagacccccatctctactaaaaatacaaaaattagctgggcgtggtggtgcatgcctgtagtctcaactacttgggaggctgaggtggaaggaccacttgagcccagcaggcagaggtttcagtgagccaagattgcaccactgctctcccgcctgggaaacagagtgagactctgtctcaaaataataataataataataaaaaaaaggaaaatgagatttggaggccatgacctgggtgccaggtttgcttgttactattcagataccacactcctagaggtcccttcagtggccagagtacatgtaacacacaaacacacactctctctctctcagttctattttcacatttatttagatgcatccataagtgaatgcacatatataactggggagaggcagagggagacggaggaccatgggttcacactgatatacccacttccaatgcaactccacagtgtccattccagtttcctgtctttctgtatttgtagctcacttcaacatgagaaacctagtttcccttattctcaatgaatttatgtatttgttcaatctcctgtatgtaaccaaactactacctccatcgcccttctcaccctgcctgcaccccaacatcccagacagctgtcccaacacgtgggtgcctcatctggcttgggtaaaccccatgccaggccaccccatgggggatgacctcctcacacccttgggagcacctgggacctccccctgcccagcatctaccttcctctgtaccacctaaaggcctcaggactgatcactccagaaagtggagcatggaatgcctcaaattactaactcacacagagagaaaaacagtaacctgacaaccacaaaaagatgatgcaaacactgaccaaatggttacagtggaaacaaccagcaaaggcaccaagtgtcctgaagagaacccagcgtctgtcaaaaaggcacagcccaaaactcatcaagaggaaacatcagacaaacccacatagaaggacactgtacaaaataactggcctgcagccttcaaaatgtcaagtcatgagaactaagaaaggttgaagaactatcccacattaaagaaagctaaagagttacaactaaaagtaacacatgatcctacactgaattctaaaccaggaaaaatgcagctaaaaaaagaaattaatagggcaagtgaaaaatgtgcctattgactgttacttggaagaatatgtatccatgttatttttctggattttgataataatactgtagttacgtaaaagaatgtcctcactcttaagaaatatacaatgaagtcttcaagatctatgacaccttcggcttattcacaaacggttccaaaaaaaatgtcccatgtaaatataaaaacatgcacaaacacacaatagagaaagtacatgcaacaacataaatggtacaaaatcttaataactggtgaatctagatagaacacatggagttctttttactgttcctgcaattgttctggaagtttgatacatcaaaaaaagttattaaaacactaacttctgtctctaacatgatagattttgttttgtcacctaattttgcttactttctgcttttctcaattatcgaatcatctagatagggtacatgtttaacaggcaaatcctttaaaacaatcacagtaacttcctttactaatctaaaacttttcaatgagttaacagaactcaaaaaagaaaattaaatactataaagatatatgctatcagatatattcattttactaagtgatgtatttgtcatgaatactcaaataatggcactccttatataaatgtgaattttaaaagctataaaggttaactagtttgtaattttggtctctaaaatatgcttgttattacaatctgtaaaaaaatcgtgactctttcttcatgaactctgcatatgcactgaggatgtcagaaaaaggagacacagtgcatgaaatctgtcacacaactttcacttaatgtttccaagccaataagatttaacaataaaataatgatttacacaggtaaaacctcacaattttttttctgtatttctttttttggcctcatgaagaaaaaaaccttataaattaatacttgacttctactgtgaagatagtaaagcttaaattcttacaaatacttcagtctttctcccaacagaatctttttgcttgcatcggatgacaatgtctcttttcattccagtttaagtctgtgccccaccccaactctgaagtcctactttttcttttcttgactagtaatattttgacctgggcagataatttttttctttgactcttttcccaaacctgttttttctatgatgacatttttttcgcaattcttagctaccattagtgtgcttcaccagttatgttttaaaaagcaataaaaatctagtgaaagtaaaaatacaaaattactgttgaattttctgaagtgtttaattcctgactgatttattcaacaagttttttttgcaaagcagtgtattaggagtcataaaaatttcaaggtattgaagacagtacttgtctttgaagattttataaatcttagtaagctataagtgagtaaatgaaaaattttttaatacctcaactatatttctttatcacaattagagtcagataaattagggaaattacaaaaatagcaatcaaacatattttgaacacactgggcttaaatttcagaagttacaaaaatacagtcctacctattatagttactccatttccattttaattacaatacacatcacaattcttctaaacattacctgacaaggctgaagtcttcaggtatccatccaggcaggggagaatgtctttgtaataaggctgcattacatgtctgtcaatataaattgaccattcttctagagcattcaggcctacttctgccaagggggtatagctcaggcccagtttgaaagccatctgtatgttaatacaaacaagttaaactgaaacgcaggaaatataagatttagaggaaaaaaacaccaagtaattgtgatttctaattaatactcctttttattactggatgcccgacaccgctggagagttcagtccaggtaattaggaggaaagcaagcagctgtctctgtggctgtggtataccgcagcctttcaaggcacacaggtttaactctcacatcgacctccaagtgcagttcagagtcaccaagggtctaagtcccaaagccagtaagtggcagaagcagaccctgacccgggcacgcctgtgaggaaacgcctgctgggactgccagggcaagaggatggtgtttctatgtgctctgggactcacaacagcgatgaagagatggctctgttcaagacaacgcctacctgcagtgcaggaacgtaggctctaacatcgagttcaatgatgttgtgtggcaaggacagaagaaaggtcaaacaagaggccaaaagttcatctttgtactgcttcattttaactgccaccttaacaagaaagaagacagtaatgtatatctgaatagagcctacatttgaaaatcaactaaaaagtatttgccctattctcaaatacaaaaattggcacgtagcctttattgacatgaccacattcacttacaaattacacactaacctccaggaaagttaatttgtcgaaatgcttaatacctactacatggaaaaacaagaatctatttcatcttgagttgtcatcactcaactgaattatgttaagagagcttgagggactttttttttttttttttttgtaagatagagtcgtgctgtcagccaggctggagtgcatggtgcaatctcggctcactgcaacctctgccatccttcaagcgattctcctgcctcggcatcccaagtaggtgggattacaggcatgtacaaccacacctggctaattttttgtatttttagtacagatgggatttcgccatgttggccaggctggtcttgaactcctgccctcaagtgatccacccaccttggcctcccaaagtgctaggattacaggcacgaaccaaagtgcctggctgagggacttttgaagcacaataacttcctctaattagtttttttaggaccttagtcccgctccagatttagcaaacacatttttatttttatttatttatttatttatttttttttttgagacacagtcttgctctgttccccaggctggagtgcagtggcactatctcggctcactgcaacctccatctcccgggttcaagcgattctcctcccccagcctcctaacctgacacaattgtttttttttgagacagagtctcgctgtgtcacccagcctggagtacagtagtgcaatctcagctcactgcaacttctgcctccagggttcaatcagttctcctgcctcagcctcacagcctactgaggagctgggattacaggcgtgcaccaccacgcctggctaatttttgtatttttagtagagacacggtttcactacattggtcaggctggtctcgaactactgaccttgtgatcctcccacctcggcctcccaaagtgctgggattaagggcatgagccaccgcacccagccccaattcttaaaataattatttatgatcactaggattttttcaatagatattcatttaaaaacagttcatgataacactaagataaatcatttaaaaattacctctttgccaaatttcacaaataaagcaaagcaagaatacttttctgggtcttcaggagagtgtttcagactctttggactaactccctgtcaaataaaacagcaagttagtacactgaacaagaatcgggagactgtatcccaatccagtagttcctagcctgtcttcagaggggtgaatccatttcaagttaccaacatctaatgaagacaggaggcagaatcagctctgcagacatttcaaggcacaggctagtcagaacaagaggagggaaggtggcagctagtgagaagccaagcacacagctaagtccattccctcttcctcatctcaccctgtaattacccaggtgggctcctcatgtgactgactggagcgtcgagaatgctaatccagttgttctcaaacttcactgggtgccagaatcacctggtggtgcttagcagggcagcagagacctgcccccaaggtttgtgatgcagaaagcaatgctcaaggctgccggtcctgggaccatactttgagaggccttgttaatcttacataattagccaggtgtttgagcatcagggcaaaaaatgctgctagctttttagagtgctatccaactgccattcacatatcaatttttttaaacacatagaataaaattagtagactttaaaactgcataggccacaatcacatattttatgatacatttatatatactcatgacctaaaaaaacgcaagattcaacatcctgcaagaaagactcacctcgaaatattttattttcttggcatttcttactgtaatagaaagcaatttgtagaaaccactgatgaggggcaaccttgtagattgcaaaattaattcatatgaaaatgagtacacccatggttcaaaaaattctgcttgtttctcagggagaatctctctgtaaaaacaaattagaaattgaaggtagaaatttgtatcattctgatcttaaaattgtaagggacataatcgaacaactaagctacaaacccatcacgtaacattttgaggtatcctaaaatgtttagttatatctataatccatttttctctacctgaggatcttttaaatataaaaaatgaaaactgtaacctagtacacttagatatattttaaagatctatataatcgattacagattttgtcttttattatttgttatttatttattttttgagacggagtctcgctccgttgctcaggctggagtgcagtggcgcagtctcggctcactgcaagctccacctcccgggttcatgccattctcctgcctcagcctcccgagtagctgggactacaggcgcctgacactatgcccggcgaattttttgtatctttagtagagatggggtttcaccatgttagccaggatagtcttgatctcctgacctcgtgatccacctgcctcggcctcccaaagtgctgggattacaggcgtgagccaccgaacccggcctattatttcatttcttacatctatataaggaatttcctatattacagccaataactaacaatcattttcattcttaaataattagaattttaccaaatacctgcaaaattccaccaggttaatgaaagccgaaaaatctttaggtttagctggatgcaagttagccgctggatctgaagttgggatcatccaaacaccaggcgcctcatctccattcttaaagagtaattgtagcaaagaaacattgtaccattcaatcacgaatcactcaacaaataactttccaactgacttcatggtcaaggcctgatgctacgaagaaagattgcaacagcgagaaagaccaagatgggtgctcaagacctatggtctgataagaagggcaggacttgcagaaagcgttaaccaaaaggactcacaggaagtgatgagagaatgggacaaataggaaaatgccagaggtgggcagcacttcttgagggagctagcaataatgccttgacagagatagaattttaataggtgacctagagatttcaagtgaagaaaaagagaaatagagaaattattaacagtagtaagaaagataaatgaaaaatgtggtattttggaagtgcatgaagatcagttttaaacacgctaagtttgtgtcaccaaatttgtgttaccaaacacaactgtgtattcaaattaaaatgttgcacaagtagttagaaatacagagcaggaaccaacaagggaggaggaggctggagaccaaatatatctgggaagtgctaacaggtggtcattgatctgttggaatgaagctggaagggcagggaacagaggagaaagggaagccactgaagacagcaatgaacacacatgttctaaaatgcaggtctgtcagctgacacagttccaggaagtccctttgggcaagttttttttttttttaataaaattattttagacatttgcaaagcacagagagcaataaaccacacatcagtgttgctacctatcatcccgcatgaaaaacagaatactccaagtgcaataaagctgatgtgaccaccggcttgtactgtgtcccttcatgtttcctctgcacatcctccccattgcctcttgtctaacttctcaggactgcagtggaggtactgacgcatgaactcgaatcagcaccatctggtctgaaacaatcactgcagtcgaaagcaagcaagacaccttcccaggatcttagttctttctcaccagccaaattaccatggagtccagttaccaccaatgcctcggaccagagcagggcagctccagacttaagccatgacttatccttttgtttttttgagatggagtctcactctgtcacccaggctggagtgcagtggcgcaatctcagctcactgcaagctccgcctcccgggttcacgccattctcctgcctctgcctcctgagtacctgggattacaggtgcccgccaccacgcccggctcattttttttgtattttgtttgtttgtttgtttgtttgtttgttttgagacagagtctcgctctgtcgcccaggctggagtgcagtggtgcaatctcggctcactgcaacctccacctcccaggttcatgccattctcctgcctcagcctcccgagcagctgggactacaggcgcccgccaccatgcctggctaattttttgtatttttagtagagacgaggtttcaccgtgttagccaggatggtctcgatctcctgaccttgtgatccgcctgcctcggcctcccaaagtgctgggattacaggcatgagccaccgcgcctggcctttttttgtattttttagtagagacggggtttcatcgtgttagccaggatggtctcaatctcctgacctcgtgatctgcctgcctcggcctcccaaagtcctgggattacaggtttcagctaccgcgccaggcctaagccatgacttatctttaactcaggctaggaaaattgggtgtgaaaaaaagggagggcattttcttatttctcttcctattatctatattttcctatatcaggaacacatttaacaccttgtaccacaatttggagtttccttaactataaacaagagcaaccccaggtttccctatcccatacaaagtcatttctacataaaataagatttctgtcactctttactattgctaaggaataagaaacaaatgaacctagtaaataattttttcaaaaaaaaaattaacatatataaattactttttgaaccatctagtaacaacattttctatacaataggttacatccaacagaaatgcatcagtggcacataataatcctgaagaaccaaattttctccagttctcctctacaaatgtgctattgtcccctaaatatttatatgcaaagacagctgatacaaaaatgatgaaaaattactactgataaaaatttctaacctcttgttccccaacagtctgtatttcaagtgtaagatccaatttctcaacaatcttcaaaacggattttacaaattcatcataaagtaaatgattcagactttcactggaggaattcacagagaaaaatgcttcatctgctaaaatagaatcctttaaataaagaaaaacaataaacttcaaaatcttgtgcaaaaatgtattagtattttataagcattaagacacatacacagatgtatgtgccggtttgggtattatggaaacagtgatgataaactgcagcagatttacctggaagttttcaagttgcaagataccttcctaaattattataacagcatcatttcagtcagatgtcatttatccagtcatgtaacaaatacttactctgtatacagcagtaagtgagaagatttaggccaatccttgtcaaagcatttaccccaattaatctgtggatgtgtatgtataaacacaaatatgtgtaatatgcatatatagacactatatcttttatgtctgtgtacatgtaagtacatgcacatatacttatgtgcatacataactaaatatgcacacatatataaacgtacacatacatacatacgtacaaatacatatatatccatcctcaggctggacctgttaggaagaacagcttagcatgagctataccatcctgctatttaaagctaaaatgaggactcagctacagtaactaatgttaaaggagttctatgtctgtgtttctttcaattcatttatttccactctcattctaacttcctgattcatacggttttaattttttatttttgaagtacactgttttaaacttttgaaagttagtaaaatataattctgaaataagtcttatgtctaaactatggagactaataaaggaagtaaggtacatttatggctttcaatggtaaatgttaccatcatctggtcagagctcaggagatgtctgaagagatccacgtagtctttgtatgtgggcaccttccatttgccagttctgacttcccctgaagcacggtggtcttcagattcagactcagggccctggccagaaagacagcatgacaatatgtagtgatggattctcagaagcagcactgctgccagaacatgctggttttcagaattttctaaattaaactgccacccataggagaccatatgattaaggaagacatcgtattaaaaaagcataatttaaaaagctaaggccaggtgcggtggctcacacctgtaatcccagcactctgggaggccaaggtgggcggatcacctgaggtcaagagtttgaaaccagcctggccaacatggcaaaatgtctctactctaaacacaaaaattggctgggcaaggtggcggtcgcctgtaataccagctacttgggaggctaagacaggagaatcgcttgaaccttggaggggaaggttgcagtgagccaagatcgtgccactgcactccagcctgggtgacagagcgagactctgtctcaaaaaataaataaataaataaatagataacggaaaaatatgtgattcttctgtgactaaaactgtgatacaccaacaagtacttcaatacaatatccactgaatgtgctatcatcatttatcttgctttcgtacatagttcaatctttcatctcatcatatgtcctataatttctgggaactaagatatgcctcccttagcaatttgtcctagagtttcaagagagaaaacatttctgatttacaaaaatgtataaaacctaaagttatgcttaaagatgtttcataccttagaagtgtattcacctaacaaaatatagaggtattatgtcctacacttttcaaaatgtaaggcattgctaataactaagaaaagaacggccacttttgcaaaattatattcgaaaacctcagcaacattcctagctttcagtgataacagattaattttctaaacattaaattcagaatttacctttggaaggaccactggtttagaacatattctgattaaaccctgatgcactgaaaaaagaaaaagaaaacaaaaatgaaggaaacactgaaaaacagaatcaaaactcacaaaaaaaaacaaacagtcattatattttggaacccaactttacctctcaatttattttctaagttcattcacggctttaattttaaaacttaaaactattggccaggcgcggtggctcatgcctgtaatcccagcactttgggaggctgaggcaggtggatcaaaaggtcaggagttcgagaccagcctagccaatatggtgaaaccctgtctctactaaaactacaaaaattagccgggcatggtggcgggcgcctgtagtcccagctactctggaagctgaggcaagagaatcgcttgaacccaggaggcagtggttgcagtgagccaagatcatgccactgcactccagcctgggggacagagcgagactcttgtcaccaaaaaaaatgaaaaaaaactattaaaattaatagttctattaatagaactattaaaattcagaggtaataggatgaaaaaaaggaaaagattttggtctaccaaaatttaggagttcaaaagttgtgtcaaagatacaaaagaatttggtaaccagattctctttacctatatcaaataatgtgttaattatccatcattactcataaatacaataaattgcaaacttacccacagtactaatgcaattcctgagaactggcccttttgctgccaaagctaggaacaccttcactatggctctgcaacacaccagctgcatttttggactgtactgtgggaaactgtctatctgcatcaccacgaggtgctccagaactggagtatacacctcaggaacctaccggaaataatcagcaaaccgtgagttagaggaggtaatcaatgaatacaggaataatacaaatattcaaagtaattacaactgaattagatacttattaaaagaaaaacatggtttgtcatctaacctgctgcttaacatgtattactgtgattgccttaaaaaaaaaacacacactcagagtaaaaattgtcttgaggtgcaattctatcccaagcaacaattccaaatctttcagaaagatggaaggagaaacaaatatttttttcctgttctggataacaaaaaatcgagtttcatgacaataattctattgccacaaagtactaactaaaactgtcatgttgttcccaacagtgcctacactaaatgtattgtatgactccatcaaattatttgaagaaatgaagattaaatacttaaaattgtgctcagtttagttcacttactgtgtcaaggtacagcaagacgcttgcaacagactggaggaagcttggcatctgataaacacggtcgtcaccagtgtctgtctgggtgaggaacatctgcttgcagcgctgaatgagctcaacgtacatgaagtcaacatcttttgcgtttataaccttgcacggctttagaaaaggtaaaacagaagtcttcatcaatcttatcaagatcaaaataatatttaaggtgtcatgttaagccatgtgattataaacacaagtttaacaaggcttcttttttttttgagacgaagtttcgctcttgtccaggctggagtgcaatggcgtgatctcagctcaccacaacctccaactcccaggttcaagtgattctcccgcttcagcctcccgagtagctgggattacaggcatgtgccaccacgcctggctattttttttttttttttgtattaagtagagacagggtttctccgtgttggtcaggctggtctcaaactcccgacctcaggtgatctgcccacctcagcctcccaaagtgctgggattacaggcgggagccactgtgcccagccacaagctttttaattaagaagaaatacagatataaaatacagtatctggccgggtgcggcggcccatgcctgtaatcccagcactttgggaggccgaggcgggcagatcacttgaggtcacgagtttgagaccagcctgaccaccatggtgaaaccccgtctctacttaaaaaaaaaaaaaaaaaaattggccaggcatggtggcgcacaactgtaatcccagctactcaagaggctgaggcaggagaatcacttgaacccaggaagcggaggttgcggtgagctgagatcgcgccactgcactccagcctgggcaacagtgaggttccacctcaaaaaataaataaataaataaaatatatctcattataaagatgctttgtataataatctgtaaccacattttaaatatttattcacacaggaagcatttattggttgtcagctatgttctaggcactgtttagacagtgggtactgaggacaaatgagaggcagtccctgccccaaggctgtccacctacaggagaggccaggagtccatacatgactggaagatgctccatgtcacacaccctaccacaccagagccattttttcagactcacaaatgcgctaatgtaattgctcaatttcagacttttccaaggcttcttttctaggacttctgaatctagtccaggctccccgaggatctgatggtgcacctcttcagatccatttcccctctcctgcctatcatgctctagccacagggacaagctcaagtggggatagatcactgtgtaaagggaaaatctcatgcaatcttttagctcagagccttctgccattctgtttcttctgccctaagcatatttaaagtcgccaacagagacaaatggagatgaagattaagaaaaagggaaaggctgggcactgtggcttacagctgtaagtccagtgctttggggactgaggcgggaggtttgcttgaagccaggagttcatgaacagtctgtgtaacgaagtgagatatcgtctctacgaaagattaaaaaatttgctgggcatggtggctcatgtctgtggtcccagttactcgggaagttaaggcagcaggattgcttagccctagaggtcagggctacagtgagttatgattgtaccactacactccagcctgagaggcaaaaaagaaaaagaaaggaaaaagggagaggccaggagcggtggctcatgcctgtaatcccagcactttgggaggccaaggtgggcggatcacctgaggtcgggagttcgggaccagcctgaccaacatggagaaaccctgtctctactaaaaatacaaaaaaaaaaatacccaggtgtggtggagcatgcctgtaatcccagcacttgggaggctgaggcaggagaattgcttgaacccgggaggtggaggttgtggtgagccgaggtcatgccatcgcactccagcctgggcaacaaaagcgaaactccaactcaaaaattaaaaaaaaaaaagaaagaaaaaaagaaagaagaaaaaaagggagagattgtaggaagaaaaaagaaatcagttgttttttctacaaagcagaagtcacagaattccactaagaggaaataactagggttattctcaatattttttctttaaaaaaaaatttttaagagatagtgtctctgttgcccagattggagtgcagtggctcgatcacagctcactgccacctctgcctcctgagtttaagagattctcctgcctcagcctcccaagcagttgggattacaggtatgtgctaccatgcccggctaatttttgtatttttagtacagacagggttttaccaccttggccaggctggtctcaaacccctgacctcaggcaatctgcccgcctcggcctcccaaagcggtgagatggtgagattacaggtgtgggccgccacacctagctaatattcttaaatatatctctttctgtcatataaactttttttttaacttctcttcctaaaacgttgtgaaatcaactacaattttactttaggaataaggagcagcatagcacagaggggaaacatggtgtttctattcttcacacttggacttatgccttggttctgtcaattctgagtctcttgacaagtttcctaatttctctgcatctcagtttgctaatctgcaaaacagagtaatactgagctcctaagggttaggagattttgagataccacatgtaaagaattctagtacacagcagacactgaagaaatcttaactgttaataaacaatactaatacagtgaccctcagtacatgcgggagggattggttccaggcctcctcagtatacctaaatccatgcatactcaagtcccacagtcaccctgtggaagcctcatatacaaaaggtcagccctctatataagtttcacatccagcacacactgtatttttgatccgtatggtagaaaaacatctgcatgtaagtgagcctgtgcagttcacgcccatgttattcaagggtctactgtattgttacaagtattagacactattcaaaatgcaatgaattagattcctttaaacaatcacgtgaaaccaagacaaaatagagtaagttaatgagacatactcctgcaaaaagtccatatccacggatagcaatagataactccttgttgttcgaatccacatttctgatgattccataaaactgctccataaagtactgcagtttatttttatgcatttctgcatttttcgccaccatattagaaacctgcaaatacataatatttatttttttggaaatatttaatagcaatggaatctatacaaacatggaaaaactagaactgtttagatgctactaatgtactgttatagttacacgcaattgcttttaatcataaagaccctttgcttccattttgcttagtctctatcaggttcagaaaagtgtcttaaataaggctatgtgatacatttttcctagagaagggactaagagaccaaggatacacataagtctgaaaaaaaaaaaaaaaaaaaaccaaaaacaggttttgaattaaggctctctgaggaagcaaagagcagtctttagagctcacctgtcacccacagggtgaaagagagctgtcaggggaccagtgacttcagacatcgtcaataaacagagttcagaacaatctcacctgtcacccacagggtgaaagagagctgtcaggggaccagtgacttcagacgtcatcaataaatagagttcagaacaatcagaaagacaaagcatctcagttttcaaaaaaataagctacaaactataaagcttaaattaagtgatgcaaggggaaaatgtcgtctgagaagcaaatagatcattatttaccaaaccaagagacaagagcctaaatgcaagaactaatacaggtattcaaagagcattccccatttcagcacaaagactgcccagaataagaatggaagaaatctatctagacaattatcaaaggcagaaaaaaaaatccaccttccactgccaacttatccatacacttcccaatccccctaaagccactaggtcttagcgcctgaccttcggggaactttgctccttatttgttttagaagaatgaaacattgtatatactgtttcataatttccttcttcacaaaacatatcataaatgtttctcaagaagtaaacaacagcattttacttaattacagaatagcaaatattatatactataatgctaattttctattattgtattcccagtaagcatgtttttaacgcatctttattcaactatttcctggatatagtattaaagacttgaaaataattattcaacagtagcagacagaggacagattaaaacactatggctcataaatatcatatattacactgccactgaaaattaatcacacagatgttggccgggcgcagtagctcacgcctgtcatcccagccctttgggaggccaagaagggtggatgacctgaggtcagcctggccaacatggtgaaaccctgtctctaacaaaaatacaaaaattatccaggcacggtggcaggtgcctataatcccaactatttgggaggctgaggcacgagaattgcttaaacgcaggaggcagaggttgcagtaacccaagcttgcgctactgcactccagcctgggtgacagagcaaaactccatctcaaaaaaaaaaaaaaaccaaaaaaacagcaacaaaaaaaacacatcatatagatgtcactgtgaggaaaatatattcaacatagtggaaaaaaggccaaaaaattatgtatcctttatgtaaagtcctctttccctctttcttcctctctcctcactccctattctgaagaaggagggaaagagggtgcctctccttgcctggggcctcaggtcacaagggatgatctaataatgggactcagggtggagctgaccacacctggtaacaatgtgactcggaatgggagctttgggtcacacagcatccctggaagccgagacccaacaacccactatgcctacagggtggggccccaagggaaaccccaaacacagaggtttgggggagcacccagtcaatgctccacacatggatgctgggaaaggaatgctgccctgactctgcggggagaggaccagggaagatccacatttggtactttcttcatctctgcactgtgtgccgcttccttcggttgatttttatctgggccctttagctgtaataaaccatagatgtgagtatcaaatttgagggtatattgcaaactcccaaacttgcaacaggcatcagccctgagggcagcattgaggatagttctcttgaacttctcccctgactaagctcaaataactttctcacgaggtagagattagcaggtagaatatatttcctcaatgaaactctaaaatctattcaatgtagttttcattaagaattggagtgggggactgaaaagtctctggcaaggatgtgaaacagagatgtctgcgtggctcattaaagacaaccagcgcagtggagggagggctggccggcttccctgcaggcccacgccccacccagccctgtgctaggaaaggcaggcatcgctagggaacaaggcccccagggtgccaccagggatgatccctctgcacacattccggacactcctccttgctaacaaggcatgaaattctctctgtcaagatgtttatcgcagtaaatgtttactgagatccaaacatattcatatgaatcagtaaaaaataattcctctgatttttatttcccttagcaagtaaggccagccaagttcagcgtaacaggagttttatgagaaggaccaaggtaacctcaaagccaagagtgacttcagggggaacacaagtctgacgggaaggccaagtacagcagggagactaaggaggcgagagggacaggcggcagaggcagaggccaaagatgaggcccatcggctcagttttttggaaggcaggcccagacatgaaaaaaggatgccagtgctctctcttctccttccacacatcccggctgtgactctcaggctaacacaactgccacactgttcacacaggtttgcatggataccctgtgaatgcagctactgtttacccatgtacagcagggcccctaagaaaacatttgttgtgaatctccagtcctttccctcagagcaaccccagaagtccacttccttaatggccaggcccctgcagccacctctggacacccaggacatcctggagaccagtgctcagaatgacaagcacggtctcctcagccgaccagacaagcttccacatacgcaggtacagattctgtaaccacctcctatccaggtggaaaatccacaatggcaaagaggcaccccttgttttcaagttgacacacaagcatctatcccctggagacagctagccctcctcttccaggagagatggggctcccctcagccctccacccactctccagccctgacctcccagcccttccggccatcacctcaccacgtctttgctccattacacttgtctcaatctaggctctgaggccctaatcaaatctggcatctccctagctctctttcagtctggctgcctcccatatggctggctgatcaacatctttctgctttaaatactacagaagctacagatcaacttgtatttattttcaaacatgcatgcatgcaaagggaatttaattctgtgtgtgaaagaaatattgttaaatgacagttgaatttgtggtacctgtttcagaaaggattccagggctgaaagtgcagcttttttcaattctacatttgtgtgggcacaccactttaacaagacttcaaatagagacacgtagttgtccagaaggcaggtgctaaactgagatgcatgcagggcaaataggcgcaagccagctgcaaatgcaaatgccattatatttaaaatcagacgacataacacagaacagaaaaccaacaaacctgcagggatatgtcaaagtcaacactgtgctcaggaagatctagtaccattacactacagtaacccagggattcctgtcagagctctaacactaccaattaacaggcccataacttggctgacaaatcccaaaacaagggtcagaagtggaatcaggattcattgaggcaaagtcagaatcaaacagcctggatcccctgaaagataccctaaaataaagtgctttcaaccatgtaacctgagtatcagcatttcaaccagagcttactaagtcaccgaaagcctccctgtaaataactgtgtgtgaaacatcacagatgttatcacatttgctttcattcaaagtttaagcaaaagcttacttgagatgttaatttagtaatctaaaatattatacctcattataaacagaatcctacctgagggcacagcatatctcttcagatcaatctattttagaaaagaaaaattcaccatcagtatttgaaagtctgcactgtaaaggcattagaataatattaatagtaatattaatcctacctgaggacgaattgcctttagtacaaaattaaaaatctcccttgaagtctggggatctagggaaataccaagaagcctgttacaaatcgtaataacagtatcacataacacactttacagacagcttgacacctatattaaccccattaatctcttgtgaattcaggagaaacatctttcatcattccatccagctaaagttgcaagttattactgctgcacggttatgactgcgagaaaacagaaagaaaatctggaataacaaagacatggtttaagcaccaacctatcacttacaagctctaagagatttaaacaccaactcatcacttaaaagctctgttagataatctctcagagcctcaattttcttatttgcaatagggaccgtatataccttttaggatagtctggaggattaaataaagtaacttactcatggccaaacataccattctccccaatacacccaggcatttattcaacacctagtacatgtaagaaaaaaattaaaaaaaaaaaaaaaacagaaaaaaaaacatagtacatgccaagatattatgacaattacaaatacaaataaattatgatctttgacctcagcatacttattaactaaaagggaagataaaacaggcacataactataacatgaggctctaatcctggcctgactgacatcacaattatttgcataactgtctcccaccacattattcattgtagctatagagtcatgctttattcatcactaatttctctacccttctaacagtgacttgtaatcagcagagactcaagaactgtttgcttttcattgcaaggactgacatatttgagacagagccctgatgatgatgtgataggaggtggagagagaatgtggtcagagaggccttaaagcagagaaacatctgtatggttgcagaatggtggcataaatgagatacaaaaaaagctactttggaattcatgacaagcagatttcttctgactatgagtattctataaaggctttccagatatggtagcatttgttctaagactgaaagaataggtactagttggggaaaaggtcattcagatagaaaatagtcatgttaataaacgcaagtgtgcagacacaaggacacccacagtacacagtgggtttagggtggggacttagcaaggacagacttctccaggctctgccctccacagtccactctcctgcagcccctccctctagtggcccactccctgtagaagcatggtcttgtatctgtttttttcaatgtggtaaaacagacatatttatcatttaaacaatgtgtacagatacaattcgttggcactaaacatattcacactgttgtgtaaccatcactattgtctatacccaaaatgttttcaccatcaataacagaagggtgcccatcaaacactaactcccatttcccctcccccagccccagtaacctctattttactttgtctctgtgaatctgactactctaagtacctcgtgtgagtgaaaccacacattgtttgcctttcgtggctggcttattccacttagcatcctgtctgcaaggttcatccatgctgcagcatgtgtcagactttcctgcctttttaagtctaagtaatgttccattgtgtctacgtgccatattttgcttatccattcatccctggatgaacacttgggtggttctggccctttggctcactatggacttgctgctaggaacataggtgtgaaaattctatcctttttttttgacaccgagtttcactctatcacccaggctggagtgcagtggcacgatctcagctcaccacaacctccacttcctgggttcaagctattctcctgtctcagcctcccgagtagctgggattacaggcgcctgccaccacgcccggctaattgttttgtatttttagtagagatggggtttcactatcttggccaagctggtcttgaactcctgacctcatgatacacctgcctcagcctcccaaagtgccgggattacaggtgtgagccaccacgcccggcctacttctactttttaaaccccctcttggccaggtgcagtggctcacacctgtaatcccagcactttgggaggccaaggtgggcagatcacctgaggtcaggagtttgagaccagcctggccaacacagtgaaaccccgtctctactaaaaataggaaaaattagctgggtgtggtggcgcataccggtaatcccagctacttggtaggctgaggcatgagaattgcttgaactcgggaggcagaggctgcagtgagccaagatcgtgccactgcactccaacaagactctgcctcaaaaaaaaacccctctcttacccccacatctcccatcagccacagcccatttctttactctcttccattacaagatttgtctagcatgttttctacaaatggcctccacttcctcccgctcttcactctagaggtcccatttctccaatgttcaatggatgtggttctcgtggagctgaacccaccacttactgccagttcctcctcctccccaaactccaccggatgcgaggcagccctgcactgcctcctcagcactctcttgagaccctccgcctggtctctgcactctcaccccctcctcatcttgctcacactcctaactttaaatactacctacgtgatgaagacctccaaatgtatagcctgaagtctgatttctgctgcaagatcccctgttacacgcacaactgcacacctgatatctaagcctggatgcttcctaagtgtctctagttaaatatatccaacacaaaaggccaggtttctacaaaaaacccggtctctcccatcccattcagcttaggagtcactgcacagccctcagtccctcactcacagtctctcaatcctacactaactcacatcccacacccaacagcagtcaggcagacccctgtgaaacatctcttggcccacatccactcctttttgaaaagctctggctcccattccatctggaatgagatcccagctcagaaaactgtcaaacaccaaccctgcgtccttcccatctcaccctggcccactttgtgtacctccacactcttgacacaccagctcttgtggaccctcggaccactgcacgcaggctaagcacagggctagagactggccgagcatggggccaggtgctgagcagctgctgcctggaatgactgctcttcccagcacttccccagctgtctccctctcctccttctgatcacgacttctgcgttacatcctcagaaagtacccgtgggtcgtgtgctccacctctccaaattctggcattcctcttcactacaccccacctctgggcactgctgaaccccaaaatcagcagagctgctttatttgttcatctgtctcctccactagactgagctcatgatggtaggaacttggtgatttcaattactggtttaacaccaagttcatcactctttagatagatggcacccatggccaggcacagtgcctcaagcctgtaatctgagcacctttgggagggtaaggcgggtggattgcttcagctcaggagttcaagacaagcctgaccgacatggtgaaaccccatctctacaaaaaatacaaaaattagttggggccgggtacagtggcttatgcctgtaatcccggcactttggaggccaaggcaggtggattgcttgagcccaggagttcaagaccagcctgggcaacatggtgaaaccccgtctctactaaaaacacaaaaattagctggacatggcattgcgcacctataatcccagctacttgggaggctcaggcacaagaatcacttgaacgtgggaggcagaggttacagtgagccaagatcgcgccactgcactccagtctaggtgacagggcaagactcaagtctcaaaaagaaaaataaaataaaaattagcaggacatggtggcatgcacctatagtccccagctacttggggaggaccacggtgggagcatcatttgagcccaggaggttgaggatgcagtgagcccatatcacagcactgcactacagcctggataacaaagtgagaccctgtctcaaaaaaaatatatttgcacacacacacacacacacacacacacgcgtttatatatatgtatatatataaaaattttttttgagatggagtcttgctctgttgccaggctggagggcagtggcgcgatctcgggtcactgcagcctctgcctcccaggttcaagattacaggcatgtgccaccatgcccagctaatttttgtatttttagtagagacgggatttcaccacgttggccaggatggtctcgatctcttgaccttgtgatctgcccacctcagcctcccaaagtgctgggattacaggcgggagccaccttgcctggccttacaattatttttataagtcattcatacagtctgtatttcctgggtgccttgttttttttttttttttgagacagagttttgttcttgtcgcccaggctggagtgcaatggcgcgatctcagctcactgcaacctccgcctcccaggttcaagtgattctcctgcctcagcctcctgagtagctgggattacaggcatgcgccaccacgcccagctaattttttgtattttttagtagagacggggtttctccatgttggtcaggctggtctcgaactcccagcctcaggtgatccgcccacctcagcctcccaaagtgctgggattacaggcgtgagccaccgcgcccggccctgggtgccttatatatatgtacccatgaattagtatttagtgcttgaagtcacatgatcatggcatcacaaaaaaagtataaattttagcctcagaccaaggcttaaatcccagacttgccatttgttagctatattagtttcctagtgttgccataacaacttaccacaaacttaatagtttaaaacaatacagatttattacctataattctaaaggtgagaagtctgaaatgattctcatattgagctaaatttaaggcatcagcagggctgtgctccttccaagaggctctaggggagaacccttttctcacttctccagcctccagaggcacccccatgccttggctcctgccgccttccagatccccttcctctgacctcctctgtgcctccctcttccacatttaaggaccctgtgatcacaccaagcccatggggatgatccaggatcatctcttcagttcaaggtcagctgattagcaaccttaattccgctatgccatgaagcataacagggattaggatgggacaccctggtggccattattctcctaaccacgcaagtcactgtgtaacttggggcaagttacttaacctgtctgagtggcagtttactaatctatacaacagagacattttacctgccatgaagagtcattacaggaacttgccttgcaacacgtctagaatagtccttaacacacaataaatgagcactaagtgctactattttccttccactatatatgttcactgagtgctgatttataagccaagtaaacataaagacaaataagcaacatcacctgccaacagggtcaaaggagagaattaaacatatgacctaacaaacttaaaatatgaccgtaagtgctgtcacagaggggagtacagaggccagaggaagtgctcacctcaggggaatcataaatgcttcctaagaggggtgacagttgaaaagaagctgaggaagtgggagccataggatacaggagagaggagagagaagacacgaaggaaaattacacagggctactctaacaatcttgataagcaaggaagaaggcatgggtagaaacattagcttaaaatgaaactgctgcctacataggttaaaaaaaaatcattggatataagtaattttgtaagtttcaacctaatggaagaaaaacaaagtaggtccaaacatttggtaattacttgaagataaagtgataaggaggccaggggtggtggctcatgccttgtaatcccagcactttgggaggccgaggcaggtggatcacctgaggtcaggagttggagaccagcctggccaacatggtgaaaccccatctttactaaaaatacaaaaatccgctgagcatggtggcacacgcctgtaatcccagctactcgggaggctgaggcaagagaaaggcttgaacccaggaggcagaggttgcagtgagccaagatcgcgccattgcactccaggctgggtgacaagagtgaaactctgtctcaaaaaaaaaaaaaaaagtgataaggaagagcaaaggagctttttccctccccttaagattattttaggatcggccaggcacagtggttcacacctgtaatcccagcactttgggaggccgagccgggcagatcacgaggtgaggagaatgagaccatcctggctaacacggtgaaaccccgtctctgctaaaaatacaaaaacaaaattagctgggcgtggtggcgggtgcctgtagtcccagctactcgggaggcttaggcgggagaatggcgtgaacccggaagggggagcttgcagtgagccaagatcatgccactgcactccagcctgggcgacagagcaagactccggaaaaaaaaaaaaaaaaaagattatttcaggataaaaagttatatttgtcctttcaaaaaaagaaaagaatttcattggccaggcgtggcaggtcatgcctataatcccaatgctttggagactgaggtgggagggtcacttgatgggaggagttcaataccagcctgggcaacacagcgagactccatctctgcaaaatataaaaggagccaggcatggtggtgcctatagtctcagctatttttgatgctgaggtgggagaactgcttgagtcaggagttcaagactgcagtgagccatgattgcatctgtgagtagccactgtacttttgcctggggagaccccatctcttaaaaaaataaaaaaaataaaaaaactgaactttagcaaaacaagggatttttgtgtaccaaaggacataatcaacacagtgaaaaggcaactcaaaaaatgagagaagggccaggtgcagcggctcacacctgtaatcccagcactttgggaggccaaggtgggcagatctcttggttggagaccagcctgggcaacatggggaaaccatgtctcttcaaaaagtacaaaaattacccatctgtggtggcacatgcctgtggtcccagctacttgggaggcggaggtaggaggatcacttgagcccaggaggtggaggcaggcagagagccatgctagcatcactgcactccagcctgggcaacagagtgagaccctgtctcagaaaaaaaaaagaaaagaaaaagggagacagaaaatatttgcaactcatgtatcatgtatctgttaagaaactggtatctggctaggcacagtggctcacacctgcaaccctagtactctggggagccaaggcaggaggatcacttgagcccaagagcttgaaaccagcctgggcaataaggcaagaccgtgtctctacaaaacattttttaatatcaggtatacacctgtggtcctagctacttgggaggctaatgtgggaggttcccttgagcccaagaagttgagggtgcagtgagccatgtttgagccactgctctccagcctgggtgacagagcaagaccctgtctccaaaaaaaaaggaaagaaagaaagaaagaaaatgatatctacaactcaacaaaaagtcaaacaaaccaattaacctaaaaaatgggcaaaagatctgaacagacatttctctaaaggcacacaaatggtgagtacatgaaaagatgcacaaccaacgtcactcatcatcagggaaacggaaatcaaaaccacgagatatcccttcgcaaccattaggcattaggatgtctgctaccaaaaacacagaaaatgacaagttagtaaggatgtggagaagctgcaacccttgtgcactgttggtgggaatgtaaaatgctgcagctactgtgaaaaacagtatgacgatttctcagaaaattaaaactaaggttaccatacaacccaacaatcacaattctaagtatatatccaaaagaatcaacagcagggactgccaacagatttctgtacaacaatgatcatggcaatactactgagaataaccagtaagtagaggcaaaccaagtgcccatatacggatgaatgaatcaacaaaatgcagtaaatacacacaggaatatgattcagccttcaaaaaaaaagacaatgctgacatatcaggatatggacaaacctgaaagacactatgctaagtgaaataagccacacaggaaaagctacataccatgagttcatctgtgtaactttttgaaatgacgaaaccacagatggagacagatgaagggttatcaggtggccaagatgggggaagagattaactatggctctaagtcagtagcacattgggacccttgtgctaatcaatctgttcaataccttgattacaatggtacatacacgtgacagaattacacaaaactcgctaggtgtggtggctcatgcctataatcccagcactttgggagatcaaggtggacagattacttgagcccaggagttcaagaccagcctgggcaacataatgataccctgtctcaattataaaaagaaaaaaaaagaattaaaaagggccaggtgcaatggctcatgcctgtaatcccagaactttaggaagttgaggcaggcggatcaccagagcccatgagtttgagaacagcctggccaacatggtgaaaccccatctctactaaaaatacaaaaattaggccgggtgcggtggctcatgcctgtaatcccagcactttgggaggccaaggcaggcagatcatttgaggtcaggagttcgaaaccagcctggccaacatggtgaaaccccatctctactaaaaatacaaaaaaaatttgccatttagtggcgagtgcctgtaatcccaggtactcgggaggctgaggcaggagaatcacttgaaccagggaggcagaggctgcagtgacctgagatcgagccactgcactccaccctgggctacggagcgagactctgtttaaaaaaaaaaagaaagtaatttgccaggtgtggtggtgcgtgcctatagtcccagctattcaggaggctgaagtgaagaactgcttgaacctgggaagcagaggttgcagtgagccaagaaagtaccactgcactccagcctgagcgacagagcaagattctgtctcaaaaaaaataaataaaattttaaacaactgcacagaactaaatacacatacacaaatgtgtgcacgttaaactggtgagatctgacaaagctcagtggacaacatcaatgttaatgcccaccttgctgttgtgctgtagttgggaaagatgtcatcatcaggggaactcgggagggcccacaggtccctctagattatttctcactactgtatgtaaattcaggattggttaagagttcaaagaaataatcaggcattgctggttagacttacagtttttgaataaagaaaatcaagtgaagccaagcaataccttcttccatggacttagtgaagttgcacagaagtgaggacaaccccttcagacatcctgccagaacaggtagtttgggctctcttactgctgatgtcatctaaaagaaaagatttaagaagatgtcattacaagagaaaaacacaaccacatctatggaagcagaatgtcataaagttcatcatacctgggtcttaagttcacccagaaaagcgcggaacaggttttctgcattatttatcatctcactaggatgaacttcacccaataatcctaggagctcatatactttttctaaaactgaaaagaaaattttagacaagtgaaggcctcaaactacatttaaataagttaaactaaccaaaatgtatgaagaaaataaaataaaataaagttcaaaattgattttacagtaagagatataaaatataaagcttttaggactgcattctttcctaagttttatgcaaatgtattaatcatatttgtcatatcttgtgagttttctatttacaggaataattttgtaaaaattaacatttttgtgaagggaagtcttcacatgttgtttttgtttggttccattttggtttattttcagcaaaaagtattcgactgtaaaataagaccttggtagagaaaacctaagtcttatgctaataatttgttaatattaatttgctaaactatttgaaaataacatgtaaatgcatctcacctgtatctggtattttttttttcaatgcaagttctccatagaatttactaaataattctccaattttaaattcatccatgagtctagaacttctaaaagtctgaagtaactaaaagaatacaaattagtacatcaatgtagtgcgggaatcaagaaaaaaaacacaatacaaattagcattctctctaaagagggaaataacgggattcctctatctcagtgcatctgtccacagcaaaggttcagaattaggtgtgtctcaaggatttacacttggtctcacaggattcacatccacccagcttatctgggaattagaggttgagatgggtatggtggaagaacatcaggggaagaatgctctaggtgtgttacgttcccaagaaaccaacaacatgactagaacctttctcccagaagcctacaaaaccaaggagcaaccagaaacaaaggaattctaaaatacaaatacaaaaaaaacagaaacaggtcacagtgaccccaacaaccacttaactgcaacgtatcaactgattcccgccagacagtggctcacgcctgtaatcctagcactttgggaggcccaagcaggcggattacgaggtcaggagttcgagaccagtgtgaccaacacagtaaaaccccgtctctactaaaaatacaaaaattagccaggcatggtggcacatgcctgtaatcccagctactcaggaggctgaggcaggagaatcgcttgaacctgggagacagaagttgcagtgagccgagattgcgccactgcactccagcctgaatgacagaacaagactctgtctcaaaaaaagaaagaaaagaaaacatatgggccgggcgcggtggctcacacctgtaatcccagcactttgggaggccgaggcgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagaaaacatatgaactctttcccattgctaaggttttaggaaaaacctcagagatataaggtgatctttcagcaattcctaatagcattaggttttgccaaagccagtaagggtgataaatgaaagagcaataaattccttagtcattttcctccttcattctcctcacaactcagaattcttcttttactacccagaagagtctgaaaacaaaaagccagggtattgtcaggtgatggttggagaatgtgcatcttacccacacatcaatgtgattagatcctatccttccccaaacacatcacccaaaacacaactcaaaactctgattttcttttaaaagttacatgtttaatgtaaaatacgtgtacttagaaacataattaccttaataagaaggtccagggctggaattttacatttagcagctctatcttttgtataaacactggtacaagtgttctaggttttaaaaaaaaaataaccaaaatcatcaataagatataaaaactaagactcagcaatacctgaaactacttctccaagaggagcaataccaaaattcagtatttagctgtggaaaatataacattaggccgggcatagtggctcatgcctataatcccaacactttgggaggcggaggtaggcgatcacctgaggtcaggagttcgagaccagcctggccagcatggtgaaaccctatctctactaaaaatataaaaattagccaggtacggtggtgcacgcctgtaatcccagctactcaggaggctgagggaggagaatcgcttgaacccgggagacggaggttgcagtgagccaagactgtgccactgcactccagcctgaaagtattcacgggactctgtggttcacgcctataatccctttgaggattacagtgtggttcatgcctgtaatccctttgaggattacagtgtggttcgtgcctgtaagcaatttgggaggcggagacgggaagatcacttaagcccaggagttcaagaccagcctaggcaacaaggcgaaaccctgtctctacaaaaaaaaaaaaaaatacaaaaattagctggacatagtggcacatcctgtggtcccagcaacttgggaggctgaggtgtgagaatcacctgagcccacgagatggaggctgcagtgagccatgattgcaccactgcactccagcctggatgacagagcaaaaccctgtctcacaaaataaaaacaaataaacaataaaaataaaaaaatacaaaataaaaattattattttttgagatggagttttgctcttgtcgcccaggctgcagtgaagttatcaagaggccatcagggccccagggagcccagggtgccactgccacctcctcaggaaaaaaaagtattaagatagttattaaaaaaaattatcaaagtagtttctctcacaaaggccttagcttactaaatctaaataactaatgggcaacaagagcaaaactccttctccaaaaaaaaaaaaaaaaaaaaaaacctaatgaagagcccacttcatttgtaacacaatgaagcagaaataagcaaattccccaatgagaaaggaaaatgttttatctttaaaataaaaatccaagttcctcacaccataagttaaaacagatgttgatatataatgtaataaggtatgttttttaattcttaccttaatttcaacagagtaaggtgcgatcttctggcccattttttctaagaaaatacataaaaactttaggatttcttctctacattcacgaaactgtaatgaaagagatacatattgtaaatatgggtaagaggagtcactccaggaatatacaagaaaagcaaaaccaaaattgtcaacttacttcaatactgttgagtgacttccggacaaatacaagcaaaccgaaatctctggaaaaaactaaagatgtctgtaatgctgttcaaaaaaataagtaaacaagttaagagagtgccaagagcatcatgtaaaccactcctaaaggggttgcaatgattttcttattattttttttgagatggagtctcgctctgtcgcccaggctggagtgcagcggcgcgatctcggctcactgcaacctccgcctcccgggttcacgccattctcctatctcagcctcccaagtagctgggactaaaggtgcccaccaccatgcccggctaattttttttttgtatttttagtagagacggggtttcaccgtgttagccaggatggtctcgatctcctgacctcacgatcagcccgcctcggcctcccaaagtgctgggattacaggcgtgagccaccgcgcctggccaaggttgcaacggttttcaaggcagccttataaatataaaacactaacccaaggttgctgtattaaaacaaagcagaaaattctagacaatgttccacagggatgcagtacgcaaaataatggccccaaagatgcctgcatcccaatccctggggtcacatcttgtgaatatgttaaatgtatatagcaaaaggaaattgagcttgcagatggaattaaggtagctaatcagctgaccttaaaatgggaagatcatactggattatccagagagcccaatgtaatcacacaggcccttaaagtaaggagatgaagaagagtgggtcagagagacaggaagttgggaaagcgggagattccaaacctctagttagggggacttgacatgctgttgctggccttgaagaccaagggaagggagctgtgatccaaggaaaggggacagcttcaagaagtatggaatgtcagggacctcaatcctatataacctgaatgaataaggcaatggatcctccccaagagccttcagaaagaaagcagccctgtctggtactttggttctagcttggtgagacctgtgtgggattctgactcacagaatcccccttacagtgggaactgtaagagtaacagacctgtgctgttttaaaccactaagcttgtggtaattgttacagcagcaataaggaactaatacacttcccctggaatctctcaagtgaaaggagatatggcataaatggaaggtaaacttggaagtgctttagaaacaagttactaaacgaacaaaaatgaattctaaatttgaaaccctgagaagagaaagtaatcacgcaatgttagttttttgtttgatatttccccattgttaatatattcttgacaacagatagagtacatataggatacatgtatatagcatctttttttttttttttttgggacggagtcgtgctctgttgcccaggctggagtgcagtggcacaatctcggctcactgcaatctccttctcctgggttcaagacattctcctgtctcagcctcccgaatagctgggactacaggcgctcgccaccatgcccagttaatttttgtatttttagtagagacaaggtttcaccatactggtcaggttggtctccatctcctgacctcaggtgatccagctgccacagcctcccaaagtgctgggattacaggcatgagccaccgcaccgtgccacatatagcatctagtttaaactgtttaagttattcctacaccatattcactactagaccctccggaagaaaatctcaccttttaatagggcacaacatcaaggtctgcatactcgtgttttaaagaaggaatacaggagatccacataattaagtatttgaatatttaaaatgctaaaaagaggcacttttactacaaaggggaaaaagttcccacccaggcattgctaaagagttaaaagaacatgacttcaattacatttcttcaatttttctcaaagtaggaacggcaaatagaggggtttggaaaaggtactggtgggattaggcgagattcaggtgaaagaaaatactttctcttggccgggcccggtggctcacgtctgtaatcccagcactttgggaggccgaggcggggggatcacgaggtcaggagttcgagaccagcctgaccaacatggtgaaaccccatctctactaaaaatacaaaaaaattagccgggcgtggtggcgcgcgcctgtaatcccagctactcggggggctgaggcaggagaatagcttgaacccgggaggcggaggttgcagtgagccgagatcgcgccacttcactccagcctgggcgacagagcgagactccgtctcaaaaaaaaaaaaaattatttctcttgccctgccccccactctgcatagcaatgattgccatattaggggtcgttttcaccaactttggctttaaaatatctttcctctaatactagggggtaaaaagcagtatgacaaatccctttatacacatacacagaaattcccccaagaatctaattgctgtacttcaaaataccgtcatctaaacacagagaagcgccgggctgcccggctccagaacgactcgggaagccaggacccacccgcggcccagctcgggccggtacccacccagcaccgcggggctgctgctcaggacgcattcctgccccaggccgcggatcagttgatgaccggccagggcagcaccgcagcggtccgcagcggacaaggtctcctgcagccgcagcagggagcaacgcacaccggctccggagcccgccatgccgccgagtcccgctcccgcgcgtgcgcccgctcggcccggacccggaaatgcccc

SEQ ID NO: 1920 - DNA, 187075 bp, Homo sapiens; identical to SEQ ID NO: 1919

SEQ ID NO: 1921 - DNA, 10827 bp, Homo sapiens
atggattaactcgaactccaggctgtcatggcggcaggacggcgaacttgcagtatctccacgacccgcccctgtgagtccccctccaggcaggtctatgaggggtgtggagggagggctgcccccgggagaagagagctaggtggtgatgagggctgaatcctccagccagggtgctcaacaagcctgagcttggggtgaaaggacacaaggccctccacaggccaggcctggcagccacagtctcaggtccctttgccatgcgcctccctctttccaggccaagggtccccagggcccagggccattccaacagacagtttggagcccaggaccctccattctccccaccccacttccacctttgggggtgtcggatttgaacaaatctcagaagtggcctcagagggagtcggcaagaatggagagcagggtccggtagggtgtgcagagggccacgtggcctatccactggggagggttccttgatctctggccaccagggctatctctgtggccttttggagcacctggtggtttggggcaggggttgaatttccaggcctaaaaccacacaggcctggccttgagtcctggctctgcgagtaatgcatggatgtaaacatggagacccaggaccttgcctcagtcttccgagtctggtgcctgcagtgtactgatggtgtgagaccctactcctggaggatgggggacagaatctgatcgatcccctgggttggtgacttccctgtgcaatcaacggagaccagcaagggttggatttttaataaaccacttaactcctccgagtctcagtttccccctctatgaaatggggttgacagcattaataactacctcttgggtggttgtgagccttaactgaagtcataatatctcatgtttactgagcatgagctatgtgcaaagcctgttttgagagctttatgtggactaactcctttaattctcacaacaccctttaaggcacagatacaccacgttattccatccattttacaaatgaggaaactgaggcatggagcagttaagcatcttgcccaacattgccctccagtaagtgctggagctggaatttgcaccgtgcagtctggcttcatggcctgccctgtgaatcctgtaaaaattgtttgaaagacaccatgagtgtccaatcaacgttagctaatattctcagcccagtcatcagaccggcagaggcagccaccccactgtccccagggaggacacaaacatcctggcaccctctccactgcattctggagctgctttctaggcaggcagtgtgagctcagccccacgtagagcgggcagccgaggccttctgaggctatgtctctagcgaacaaggaccctcaatcccagcttccgccctgacggccagcacacagggacagccctttcattccgcttccacctgggggtgcaggcagagcagcagcgggggtaggcactgcccggagctcagaagtcctcctcagacaggtgccagtgcctccagaatgtggcagctcacaagcctcctgctgttcgtggccacctggggaatttccggcacaccagctcctcttggtaaggccaccccacccctaccccgggacccttgtggcctctacaaggccctggtgggcatctgcccaggccttcacagcttccaccatctctctgagccctgggtgaggtgaggggcagatgggaatggcaggaatcaactgacaagtcccaggtaggccagctgccagagtgccacacaggggctgccagggcaggcatgcgtgatggcagggagccccgcgatgacctcctaaagctccctcctccacacggggatggtcacagagtcccctgggccttccctctccacccactcactccctcaactgtgaagaccccaggcccaggctaccgtccacactatccagcacagcctcccctactcaaatgcacactggcctcatggctgccctgccccaacccctttcctggtctccacagccaacgggaggaggccatgattcttggggaggtccgcaggacacatgggcccctaaagccacaccaggctgttggtttcatttgtgcctttatagagctgtttatctgcttgggacctgcacctccaccctttcccaaggtgccctcagctcaggcataccctcctctaggatgccttttcccccatcccttcttgctcacacccccaacttgatctctccctcctaactgtgccctgcacccaagacagacacttcacagagcccaggagacacctggggacccttcctgggtgataggtctgtctatcctccaggtgtccctgcccaaggggagaagcatggggaatacttggttgggggaggagaggaagactggggggatgtgtcaagatggggctgcacgtggtgtactggcagaagagtgagaggatttaacttggcagcctttacagcagcagccagggcttgagtacttatctctgggccagggactgtattggatgttttacatgacggtctcatccccatgtttttggatgagtaaattgaaccttagaaaggtaaagacactggctcaaggtcacacagagatcggggtggggttcacagggaggcctgtccatctcagagcaaggcttcgtcctccaactgccatctgcttcctggggaggaaaagagcagaggacccctgcgccaagccatgacctagaattagaatgagtcttgagggggcggagacaagaccttcccaggctctcccagctctgcttcctcagaccccctcatggccccagcccctcttaggcccctccaccaaggtgagctccccctccctccaaaaccagactcagtgttctccagcagcgagcgtgcccaccaggtgctgcggatccgcaaacgtgccaactccttcctggaggagctccgtcacagcagcctggagcgggagtgcatagaggagatctgtgacttcgaggaggccaaggaaattttccaaaatgtggatgacacagtaaggccaccatgggtccagaggatgaggctcaggggcgagctggtaaccagcaggggcctcgaggagcaggtggggactcaatgctgaggccctcttaggagttgtgggggtggctgagtggagcgattaggatgctggccctatgatgtcggccaggcacatgtgactgcaagaaacagaattcaggaagaagctccaggaaagagtgtggggtgaccctaggtggggactcccaccagccacagtgtaggtggttcagtccaccctccagccactgctgagcaccactgcctccccgtcccacctcacaaagaggggacctaaagaccaccctgcttccacccatgcctctgctgatcagggtgtgtgtgtgaccgaaactcacttctgtccacataaaatcgctcactctgtgcctcacatcaaagggagaaaatctgattgttcagggggtcggaagacagggtctgtgtcctatttgtctaagggtcagagtcctttggagcccccagagtcctgtggacgtggccctaggtagtagggtgagcttggtaacggggctggcttcctgagacaaggctcagacccgctctgtccctggggatcgcttcagccactaggacctgaaaattgtgcacggcctgggcccccttccaaggcatccagggatgctttccagtggaggctttcagggcaggagaccctctggcctgcaccctctcttgccctcagcctccacctccttgactggacccccatctggacctccatccccaccacctctttccccagtggcctccctggcagacgccacagtgactttctgcaggcacatatctgatcacatcaagtccccaccgtgctcccacctcacccatggtctctcagccccagcaggccttggctggcctctctgatggagcaggcatcaggcacaggccgtgggtctcaacgtgggctgggtggtcctggaccagcagcagccgccgcagcagcaaccctggtacctggttaggaacgcagaccctctgcccccatcctcccaactctgaaaaacactggcttagggaaaggcgcgatgctcaggggtcccccaaagcccgcaggcagagggagtgatgggactggaaggaggccgagtgacttggtgagggattcgggtcccttgcatgccagaggctgctgtgggagcagacagtcgcgagagcagcactgcagctgcatggggagagggtgttgctccagggacgtgggatggaggctgggcgcgggcgggtggcgctggagggcgggggaggggcagggagcaccagctcctagcagccaacgaccatcgggcgtcgatccctgtttgtctggaagccctcccctcccctgcccgctcacccgctgccctgccccacccgggcgcgccccctccgcacaccggctgcaggagcctgacgctgcccgctctctccgcagctggccttctggtccaagcacgtcggtgagtgcgttctagatccccggctggactaccggcgcccgcgcccctcgggatctctggccgctgaccccctaccccgccttgtgtcgcagacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggccgggttgggggcgcggcaccagcaccagctgcccgcgccctcccctgcccgcagaggtgagcttcctcaattgctcgctggacaacggcggctgcacgcattactgcctagaggaggtgggctggcggcgctgtagctgtgcgcctggctacaagctgggggacgacctcctgcagtgtcaccccgcaggtgagaagcccccaatacatcgcccaggaatcacgctgggtgcagggtgggcaggccccctgacggggcgcggcgcggggggctcaggagggtttctagggagggagcgaggaacagagttgagccttggggcagcggcagacgcgccccaacaccggggccactgttagcgcaatcagcccgggagctgggcgcgccctccgctttccctgcttcctttcttcctggcgtccccgccttcctccgggcgccccctgcgcacctggggccacctcctggagcgcaagcccagtggtggctccgctccccagtctgagcgtatctggggcgaggcgtgcagcgtcctcctccatgtagcctggctgcgtttttctctgacgttgtccggcgtgcatcgcatttccctctttacccccttgcttccttgaggagagaacagaatcccgattctgccttcttctatattttcctttttatgcattttaatcaaatttatatatgtatgaaactttaaaaatcagagttttacaacttttacatttcagcatgctgttccttggcatgggtccttttttcattcattttcattaaaaggtggacccttttaatgtggaaattcctatcttctgcctctagggacatttatcacttatttcttctacaatctcccctttacttcctctattttctctttctggacctcccattattcagacctctttcctctagttttattgtctcttctatttcccatctctttgactttgtgttttctttcagggaactttcttttttttctttttttttgagatggagtttcactcttgttgtcccaggctggagtgcaatgacgtgatctcagctcaccacaacctccgcctcctggattcaagcgattctcctgccgcagcctcccgagtagctgggattacaggcatgcgccaccacgcccagctaattttgtgtttttagtagagaaggggtttctccgtgttggtcaagctggtcttgaactcctgacctcaggtgatccacctgccttggcctcctaaagtgctgggattacaggcgtgagccaccgcgcccagcctctttcagggaactttctacaactttataattcaattcttctgcagaaaaaaatttttggccaggctcagtagctcagaccaataattccagcactttgagaggctgaggtgggaggattgcttgagcttgggagtttgagactagcctgggcaacacagtgagaccctgtctctatttttaaaaaaagtaaaaaaagatctaaaaatttaactttttattttgaaataattagatatttccaggaagctgcaaagaaatgcctggtgggcctgttggcctgtgggtttcctgcaaggccttgggaaggccctgtcattggcagaaccccagatcgtgagggctttccttttaggctgctttctaagaggactcctccaagctcttggaggatggaagacgctcacccatggtgttcggcccctcagagcagggtggggcaggggagctggtgcctgtgcaggctgtggacatttgcatgactccctgtggtcagctaagagcaccactccttcctgaagcggggcctgaagtccctagtcagagcctctggttcaccttctgcaggcagggagaggggagtcaagtcagtgaggagggctttcgcagtttctcttacaaactctcaacatgccctcccacctgcactgccttcctggaagccccacagcctcctatggttccgtggtccagtccttcagcttctgggcgcccccatcacgggctgagatttttgctttccagtctgccaagtcagttactgtgtccatccatctgctgtcagcttctggaattgttgctgttgtgccctttccattcttttgttatgatgcagctcccctgctgacgacgtcccattgctcttttaagtctagatatctggactgggcattcaaggcccattttgagcagagtcgggccgacctttcagccctcagttctccatggagtatgcgctctcttcttggcagggaggcctcacaaacatgccatgcctattgtaggagctctccaagaatgctcacctccttctccctgtaattcctttcctctgtgaggagctcagcagcatcccattatgagaccttactaatcccagggatcacccccaacagccctggggtacaatgagcttttaagaagtttaaccacctatgtaaggagacacaggcagtgggcgatgctgcctggcctgactcttgccattgggtggtactgtttgttgactgactgactgactgactggagggggtttgtaatttgtatctcagggattacccccaacagccctggggtacaatgagccttcaagaagtttaacaacctatgtaaggacacacagccagtgggtgatgctgcctggtctgactcttaccattcagtggcactgtttgttgactgactgactgactgactggctgactggagggggttcatagctaatattaatggagtggtctaagtatcattggttccttgaaccctgcactgtggcaaagtggcccacaggctggaggaggaccaagacaggagggcagtctcgggaggagtgcctggcaggcccctcaccacctctgcctacctcagtgaagttcccttgtgggaggccctggaagcggatggagaagaagcgcagtcacctgaaacgagacacagaagaccaagaagaccaagtagatccgcggctcattgatgggaagatgaccaggcggggagacagcccctggcaggtgggaggcgaggcagcaccggctgctcacgtgctgggtccgggatcactgagtccatcctggcagctatgctcagggtgcagaaaccgagagggaagcgctgccattgcgtttgggggatgatgaaggtgggggatgcttcagggaaagatggacgcaacctgaggggagaggagcagccagggtgggtgaggggaggggcatgggggcatggaggggtctgcaggagggagggttacagtttctaaaaagagctggaaagacactgctctgctggcgggattttaggcagaagccctgctgatgggagagggctaggagggagggccgggcctgagtacccctccagcctccacatgggaactgacacttactgggttcccctctctgccaggcatgggggagataggaaccaacaagtgggagtatttgccctggggactcagactctgcaagggtcaggaccccaaagacccggcagcccagtgggaccacagccaggacggcccttcaagataggggctgagggaggcccaaggggaacatccaggcagcctgggggccacaaagtcttcctggaagacacaaggcctggccaagcctctaaggatgagaggagctcgctgggcgatgttgggtgtggctgagggtgactgaaacagtatgaacagtgcaggaacagcatgggcaaaggcaggaagacaccctgggacaggctgacactgtaaaatgggcaaaaatagaaaacgccagaaagggcctaagcctatgcccatatgaccagggaacccaggaaagtgcatatgaaacccaggtgccctggactggaggctgtcaggaggcagccctgtgatgtcatcatcccaccccattccaggtggtcctgctggactcaaagaagaagctggcctgcggggcagtgctcatccacccctcctgggtgctgacagcggcccactgcatggatgagtccaagaagctccttgtcaggcttggtatgggctggagccaggcagaagggggctgccagaggcctgggtagggggaccaggcaggctgttcaggtttgggggaccccgctccccaggtgcttaagcaagaggcttcttgagctccacagaaggtgtttggggggaagaggcctatgtgcccccaccctgcccacccatgtacacccagtattttgcagtagggggttctctggtgccctcttcgaatctgggcacaggtacctgcacacacatgtttgtgaggggctacacagaccttcacctctccactcccactcatgaggagcaggctgtgtgggcctcagcacccttgggtgcagagaccagcaaggcctggcctcagggctgtgcctcccacagactgacagggatggagctgtacagagggagccctagcatctgccaaagccacaagctgcttccctagcaggctgggggcacctatgcattggccccgatctatggcaatttctggagggggggtctggctcaactctttatgccaaaaagaaggcaaagcatattgagaaaggccaaattcacatttcctacagcataatctatggccagtggccccccgtggggcttggcttagaattcccaggtgctcttcccagggaaccatcagtctggactgagaggaccttctctctcaggtgggacccggccctgtcctccctggcagtgccgtgttctgggggtcctcctctctgggtctcactgcccctggggtctctccagctacctttgctccacgttcctttgtggctctggtctgtgtctggggtttccaggggtctcgggcttccctgctgcccattccttctctggtctcacggctccgtgactcctgaaaaccaaccagcatcctacctctttgggattgacacctgttggccactccttctggcaggaaaagtcaccgttgatagggttccacggcatagacaggtggctccgcgccagtgcctgggacgtgtgggtgcacagtctccgggtgaaccttcttcaggccctctgcccaggcctgcaggggcacagcagtgggtgggcctcaggaaagtgccactggggagaggctccccgcagcccactctgactgtgccctctgccctgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtgacgggctggggctaccacagcagccgagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggcacatcagagacaaggaagccccccagaagagctgggcaccttagcgaccctccctgcagggctgggcttttgcatggcaatggatgggacattaaagggacatgtaacaagcacaccggcctgctgttctgtccttccatccctcttttgggctcttctggagggaagtaacatttactgagcacctgttgtatgtcacatgccttatgaatagaatcttaactcctagagcaactctgtggggtggggaggagcagatccaagttttgcggggtctaaagctgtgtgtgttgagggggatactctgtttatgaaaaagaataaaaaacacaaccacgaagcca

SEQ ID NO: 1922 - DNA, 4219 bp, Homo sapiens
tatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacactgtggacaaatgagaaaagaacatggagtcacctttcacctcagcaagttcctgtcactgatgttatgttgaaggcagcaacaagacacatgcgcaagcttaaaaccatatgactgggcctttaatgcccttcttctgactctgaaaatttcctccctactactctccctcctttgagtctctcaatcattttcttttttttcttttgagaaggagtctcactctgtggcccagactggaatgcagtggcgccatcttggctcactgcaagctccacctcccaggttcaagtgattctcctgcctcagcctcccaagtagctgggactacaggcacccgtcaccacgtccggctaatttttgtagttttagtagagacggggtttcgccatgttggccaggctggtttctcaatcttaaatcaccccccccaccacccgccgactcctcccaggcatggtggtgggagcattggtctcttactattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggaccctataagatgaaagatttcaggctgaaattggagaggaagatgttggtaacatgggggttcaaatatgagacataaaaagtgaacaaaagaattaatattaccacaagaacattggaattaggaaaccactttggtaaagtcatcgaactttagaaatgaaaaaggaaaaacaaacttgaaatcaactgtttaacaaaagggacaagcttacaaaacacatgcaatgattcatatctgggccaataaatagtccatggatatactgaaacagttctataaccaagcactctatatgccatgcatcttgtcagggagggagtaggagtatatgatgggaaacagatctgtcatccatagggaacatggtgggggaacatgaagaatggagagcacccaccttcttatcccagccacagatcatactgcccatagagaggcccatgccccggtactggcacatcatgttggacagcagcttggaggctgccgacactgaaatacgttctccatttcgcagatagtacagcctgggtgaggacaaggtggagtgaggaaagagaggttagctctttccaacttgatggggcaggaaatgattaaagagataagcattggaaaggaattattttgtaggatctaaagatcagagaaagatttggaatttaaagtatctgaaacatacaaaggcagcctagtaaatgatactgtcccgccagggtggatgtgtcagtgctaaatacctgacgtactatctggcttatgagtggagcacaggctgagatttgggagaagggtcttatcaccaaaaagctgttttgtgaaatatactattagcactaagatggaccacataggacaagagtaaggagcaatgatctgagagatccagggattaaccactaggctaagaaaggaagatgagaggcctcgcttacctgcattccttggccagcaggcgctcccagtactgacagtctgctgcacagccagacatggtgccaagcaggtaagggttaatctcaatcaccttgttcacccgtaaggcacctggaagaagatggagctttgggagagaagggatgaccccatagatcccccagtgtgtcctaaatcaatatccacttccactttgttgcagagttggcctcctgtggaaaggagagcccagctccccagattctgcctgctggagcgtatacactcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgataagagaaaagaggttgagaaaggcaatgaaaaattctgtagtaagaggctccaggaaaaggttttagggagtatgagggtgaggagatatgcagaaatgatctaaccatcaataaatgaaacagttaataaccaatctctagaaggaaatggcttgggagaaggaaaagaagaggcatgccagtatcaaccttttccattttccagcacaacagaaatgaaagcaagcacatgttaccattactaaaaaattttgagagtgacttaaagggtttcttccatgcataaagcattcaaccctcacaaaacacgtttagtaacagtatcctcactttacagaagaggggcttgggacctagactaagtgacttgttctaagtcgcgcaacagtgagttgctgagaggaggccagcaggcaaatttcataggtttcccaagacaccacacacctcctatatcatgtgataaccccatgaaaaaggctccaccatttgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgctctcggaggaggaagtgaaagcgaaagccacagatcgaaggggagggaacaagactcttttccacatccccctgccttttccgagaaaaggacagttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagttgtgaggcgcgcccagtccctctgttcccgcctggcacttgctctggccgcgcccgccc

SEQ ID NO: 1923 - DNA, 3323 bp, Homo sapiens
tatttataaccgtttttctttattctacttagtggggcacccagaaacttccctgggggaaatgcttgttcaaatagagaacacgcagaagatgcacttcaccggcctcctctggctgctgagcccgtactctctctttggctcaggctaggcctcttcttctccttggacttaacgtggcttaggtccctgagtcggccaagacctcccagaggagacctgcccagctgccaccaccaccattattgattggcttcccggtactggtgcagcaggtcactgacatctgtactttctactttcacccaaccatcttccttcatgtggtacactgtggacaaatgagaaaagaacatggagtcacctttcacctcagcaagttcctgtcactgatgttatgttgaaggcagcaacaagacacatgcgcaagcttaaaaccatatgactgggcctttaatgcccttcttctgactctgaaaatttcctccctactactctccctcctttgagtctctcaatcattttcttttttttcttttgagaaggagtctcactctgtggcccagactggaatgcagtggcgccatcttggctcactgcaagctccacctcccaggttcaagtgattctcctgcctcagcctcccaagtagctgggactacaggcacccgtcaccacgtccggctaatttttgtagttttagtagagacggggtttcgccatgttggccaggctggtttctcaatcttaaatcaccccccccaccacccgccgactcctcccaggcatggtggtgggagcattggtctcttactattgacaacgcctccagaatagctgtctctgtgagtggcataagcaatagccctgcggccaaggtcataggcctcttcagggctaagattaggccgatagccactgtccatgaccccgtaggcataagtgttcccactacccgtggagaacatatttcctgagagccgagtcccatgttcatccacgtagtagagtccaggaccctataagatgaaagatttcaggctgaaattggagaggaagatgttggtaacatgggggttcaaatatgagacataaaaagtgaacaaaagaattaatattaccacaagaacattggaattaggaaaccactttggtaaagtcatcgaactttagaaatgaaaaaggaaaaacaaacttgaaatcaactgtttaacaaaagggacaagcttacaaaacacatgcaatgattcatatctgggccaataaatagtccatggatatactgaaacagttctataaccaagcactctatatgccatgcatcttgtcagggagggagtaggagtatatgatgggaaacagatctgtcatccatagggaacatggtgggggaacatgaagaatggagagcacccaccttcttatcccagccacagatcatactgcccatagagaggcccatgccccggtactggcacatcatgttggacagcagcttggaggctgccgacactgaaatacgttctccatttcgcagatagtacagcctgggtgaggacaaggtggagtgaggaaagagaggttagctctttccaacttgatggggcaggaaatgattaaagagataagcattggaaaggaattattttgtaggatctaaagatcagagaaagatttggaatttaaagtatctgaaacatacaaaggcagcctagtaaatgatactgtcccgccagggtggatgtgtcagtgctaaatacctgacgtactatctggcttatgagtggagcacaggctgagatttgggagaagggtcttatcaccaaaaagctgttttgtgaaatatactattagcactaagatggaccacataggacaagagtaaggagcaatgatctgagagatccagggattaaccactaggctaagaaaggaagatgagaggcctcgcttacctgcattccttggccagcaggcgctcccagtactgacagtctgctgcacagccagacatggtgccaagcaggtaagggttaatctcaatcaccttgttcacccgtaaggcacctggaagaagatggagctttgggagagaagggatgaccccatagatcccccagtgtgtcctaaatcaatatccacttccactttgttgcagagttggcctcctgtggaaaggagagcccagctccccagattctgcctgctggagcgtatacactcactaatgtaggacccagctgaggcccgagaatccactgctgcaatcactccatgctggaacttgaaggcgagcgtggtggtgccatgggccatctcaatctgaacgttcctttctccgtccccacccagggactggaagaattctgtgggctgataagagaaaagaggttgagaaaggcaatgaaaaattctgtagtaagaggctccaggaaaaggttttagggagtatgagggtgaggagatatgcagaaatgatctaaccatcaataaatgaaacagttaataaccaatctctagaaggaaatggcttgggagaaggaaaagaagaggcatgccagtatcaaccttttccattttccagcacaacagaaatgaaagcaagcacatgttaccattactaaaaaattttgagagtgacttaaagggtttcttccatgcataaagcattcaaccctcacaaaacacgtttagtaacagtatcctcactttacagaagaggggcttgggacctagactaagtgacttgttctaagtcgcgcaacagtgagttgctgagaggaggccagcaggcaaatttcataggtttcccaagacaccacacacctcctatatcatgtgataaccccatgaaaaaggctccaccatttgtgtgtggacaagggcaggaaagttctcttgtcttcctttgggagcccccacctcacctgtaactctttgtcctaacttgcacttcctcctctcaggccccatccccatgtggcctcttctttgggtctggcgctctccgggactgaaggctacccccgaccctgtaccccgcgctcccgctctcgcctcctcctctcaggcgaccctccactcctcagcgcccgcctccctgcatccctaggggcttccctactgccccgacctgcattccccggggtaaagcgagctctggagatcgcatagagaaactgtagtgtcctgggtccgagcgacgcccgcttcccgcaaccgggagagccgattccggccgctgccctcggggggctccgcatacatctagtagcgccatgaccgcccagcacccagagatctgtccgctctcggaggaggaa

SEQ ID NO: 1924 - DNA, 105338 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggctggcacatccagggacccgggccggttttaaacctcccgtgcgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaatctttgcagtttcaggtacaacacattggttttgattagggatggggatggggccctctttttgcagaatggggaaagtattgacaggaattgagagctattggtaggccagtgtataaggtatgtgaaaacagaattaagttattggtctgaagtgactgaagcatttaggctctatcaaggcctaaaatttggtaatatgagtttggtaatgcgaattgtggcagtggacaatatttagttaaaattatgtaattgcataagtactagcacagtatttttaataaaagttatttcttagcaaatgtcagttgcattttgtctaaaggtagagtgacactacagtgtctatatgtcctgctaaaaattgtggggaatatttttttttaagacagcgtttatatcgggagaggttttattccgttggattatgttagctgcatataaatgtgcacagttaattttgcccaagtttttgttttgaaatgaatgtaaaacttactgaagaagtagcttcccaaaatttagttttctgttaagccaaaaatattattttaaaagagtatttgcaaattttgaagttgacattaattgagaatgttactaaggctaaactggacccgcttgcccagaagataattatggaaaaattcttttgtgacttccaaagcagtctactattagcatgaattactgacagtcatccaaatatataggaacaaaaaattaaatgtttatgtaactttgaaaaaaaagcctttgaagaaaataattgaatgctgtctgggagacagatttctttcagcacttaaagtacataacacactacttttacttttcccacttgattttaaattatcagggttattaagaccttaaaattattttaccaggtttttacatgtgagctgtgacatgactggcattttctttgatttcagcgtatgttggtctctacacatgaaatttgtgtgacttaaaactttctctaaaactgtacttttagttatgatatgcatagaaagcagtatcaaatattgcgtcaaatgactaataacacttaatttctagagttgtggttttattgagccaaaagttgatatgaaaaaaagtcagtaaggaaagtcagtgaagtgcttgcttttttgataattgcactcccaataattttgatattccaacgtacttggtttgcttgttttcacgttaatgttttctgtttattggagtgggaaggcattaaaattgtcattgaagactttgtctttgacatgttgtagtatttatttcagtaactaacctgtgaaaagttaaattcctttatgaaagtagtgattggagtatttttatctgataaagaaagattaataatgaagccatttctccgaggaaaattgaggacaataattcagttttaaaatattatcgcaaaattaaattattctaaaaatttgttagtagggttatatgcttaatattagtctgaaatatagtgctgaatttgagactatagaaaaattaagtgtatttagggtatgtggaaacgttaggcttctgttgtatttttattgtttggtagatttgcctcttttcaaataaatgttcacagggaatacttttaacttgtagagagtacagtgactattgaagttacctaaattacctcaaggtaagtgattactgaaattaatcatgagggttttaaaaagtattctattcacaacatttattttacattgttttgtatctgctaagttatatttcctgaaaaacatgactggaccacctaattgctgtatgataacttacaaacttcatttttcatagtgcttattcaagtgtaaagcacaactgaaaggagtaatgtacagtttatatgaggaaaaaggaattttattgctgccagtgtaaaagtttgcacagcagtatagtcatcaatgcagatttacattgcttataatatactaagtaaatactaaatgattaaagataataaaatatggtgaggtataaccaccttcattttaaacttagttttagaagatagtaaagaaagattcctttattacctttttagaattttatttttaataacatgggaaaggcaactggtgatattttaatttttgtatggaacagtgcatctgctttctcatagccacataaaatacataaacttcttagtgttatgaaatggcttactttttggaagtgaagaagtcttcaattcttattttctaatgttattttgaaatttgcctccatttgctgtttgttcatttggtgatagcgcaacacttaaaaaaatattttaagccgcttctgaagtaatcacttcagtgacttttaatggaggagtatttgttatgggaaattcacttcacaaagttttaacattaattcacttgaagtaaacgtgctatttttaaattttcatctcaatcttttaagtaagacgaaagcttaggaaatcacttttattattgatattgtgtgtgacttcagagtttgtaaagagaattgtagaagtgttgcatgcatatgacaattttctgcttaattgaaatgtgaggcctctgccatactacaaggatttagcttccagaaaatgtaatattaacatagcttaagaaatgtatttttttttttctgtagaaaccgttgggttaaacaaacagttcagaagttttattacatggaacccattagttcttaatcttgttacctttttcttcattttttctgttaaacttgattttcacagtcagcattgaagaattcatcttgtggcctgaattcattaagaaaagatgttaggatttgttctgaagatagtgacttaggaaatttgtgagactggggtcagtcagttctgttttacaattgctttctatttggtagctttgaaattaatttagttgcttatcagagagaataatgttgaggttagactaaccttaaattggtaaggctttgctgagcaaactgataactgtaagtcttttatagggtgcattactgccacatatacgttcttccataggtggttaaaagtatattggtctgtgtttggtgattctctttgtacatattgagtatatgcattcactaatgtaaaataatttgccaagaaaggtgaaattagtatattgtacttgactattcacctttcccttagttttttgaatttttttcattggttgcagaggaagtattagcaatttaattcttttaaaataatttgcactggaataaataagtatcggcaaatataagaagagtaacataatttaagggtgaattaattttatttgggaagttttagttctgtatagttaaggcagattcttcatttgcaacagttgacattgggacatgtgtgaacatcttcaaggtattaggacatcttcaaggcattactttttggcagtgttgagaatttttttttttttttttttttttttgagatggaatctcgctctatcgcccagtctggggtgcagtggcaggatctcggctcactggaacctctgcctcccaggttcaggcgattctcctgcctgaacctcccaagcagctgggattataggtgcatgccaccacgcccagatagtttttgtacttttagtagagatggggttttaccaccttggccaggctggtctcaaactccagacctcaagtgatccgcctgcctcggcctcccaaaatgctgggattacaggcgtgagccactgcgcctggccagtgttgagaatattgagagatggatattgtagctgtacctgccatcaaaagaattttcttgacctccacatagtgtgaaaaagaagactgtttacacattatattttaagtaattatacacataattattatcagtactcaccacttcaaatatgaacagtgaatctaaccagtgtttgatttctctgtgtgtgtatgtgtatacaaagttagcaaaccttttatcttaatatttattaaaaaacgaatttttgtttctttaaagaaaagactaccttagagaatattgttctatagtttttaaatatggtcagatctattttaaattatgttaaaattttgagtattacgtttatctatacttttaagcatatatacattgtttcattttagattttagggaggcagtgtgggctctggagccagactgcttgttttgtaatcctggatcttccatttagtagctggatgactttgagtaggttatttagattttctcaatctattttatctgtaaaatggggatgataatggaacctaccgcatacgtttatcttgaatagtaagtgagataataataagtaatttcatttagcatagtacctgccacattgtaaatacttaaatggtagctactgctctgaaaaactgtaatttcaggttatgtatgtagggaaattatttgtattttcatttatggtgtatgattgtaactgaatttcctcagtttgggccatgttaggattttgtttcaagttataagtgtttttaaaaataagggtattcctttaggaagtctgggtatgacatgtctgtgattttgctggttcatcacaaatgggaaataaatctctgctaactcaaactgttgaccaaagtaaaattaattatgccaatcaaaaactatttgctttaaaatataaaaggcaaaaacttcctattagcataatgaagtagaatttttaaactttgttataatcttaaattttctttagtgttgaagataggtcaacttaactatcatacatttttattcacataaagtaaactctgcctcaaatgtaataaacttaatatgagttatgtaaactttggtcaatagaggtatattttttagcatttccttttgaaaatttcagccttttgagggagtcttgcaactgaatgtcaagttacatttattacaataaaatggacacttaatataatctgtaatgcattaacataatatgggaacttttaaagtattcagtctctgtattattgagtcctatttccacatttggccaggattctcaatatgatttaggcccaagacgtgggaagaaagaagtaaagaactaaaggatttttttcttcatttttttaattgaatatggggaaagatggaataagcttatctgtccagtaaaggccattatgtgtacatagggattattatttttcccccccttgggctgtactgatttcccagatgtaccacagcactcttagtagtgaagcacttgacttctagtgagtggattttttgtgtgtgtgttttatattgcagagtgaatacactctgtctgatactatgtgactttctgattatgtgatttttatgcattttatgtgttttgtaaactagctgtatttttggtccatgtctaggttgtagaattgaattgtgcattttggcatctgagcacagctgagttttctaaatcaatctctctccttgcacctagtttttgctttagatcactacctaagacttactgttgatttaatattagagcacttaagcatagctttgacttttatttcctttgatttttgtagattttcaggctgaagtacaataaggttctctgttctttactagtaattgcaaagattgtattctgtgaattttatttgtttaatacttttgatcttttgaagaggatgtaattatttaaggtattatgaaatgcattgtgatttgaattagatactctttggagatggagttttgctgttgttgcccaggctggagtgcaatggtgtgatctcggctcaccacagcctccgcctcctgggttcaagcaattctcttgccgcagcctcccaagtagctggaattacaggcatgcgccaccacgcccggctaattttatattttttttttcagtagagatggggggtttctccatgttggtcaggctggcctcgaactcttgacctcaggtaatctgcctgtctcagcctgctaaagtgctgagattacaggcatgagccactgcgcccggcctcagatactcttttaattagatgcgtttaaaaatttaacccaccattgctggcatgaatagatgtatttttagagtgattcataaatatcgtatacatgtttaaagttacaaactttttgcttatttcaaaatgcaggattcttttccatttaaaattccctctctttgtgagacttctttttgagtattctggttactctaaactgattggagatgaaattagatagaattgaaaactgtacttttaaaatgaaattttggggatgtcattaagcttgattttttaggttttttttttagtgtgtattataaattattttacactgattgtcagcgataaaatggaatgcctgggattttttaaaatttattttattcatttttataaggtaaaaacagtgttttgctaggcttaatttgaccatgttgtaaaatttattgtataccttgaaagaatcatttatgaaagatactgaattagctaatatatactctgtcttatgtagtttttgattaacaatacactttttaaatcattagctcatttgattttgcaaagaagaacaggtaacctaagaggcagacagaacaggcattacttttatttttctttcttttttattttatttatttatttatttatttattttttgcagcttaggaattgtagctccagtggaatcagtatcttgttaatggctagtgaaagactgagtctgaagaaggatgcaggacttttttggcacttggtgcagtatttttcccattatgttacatgagtggttcttaaacttcagtgtgttagaacaacctgaagggcttattaagctatggattgcttactccaccctcagagtttctgattcagtaggtctggattgggacctgagaatttttatttcttagaagttttcaagtgatgctgatgctggtgctctggggatcacactttgaggaccaccaatgaacattatctcccaccaagcaaacccttaacatgttatactcctttaggttattagaatttatacatgcattatttcatttgacctgtaaactctaagtaactttgcatggaaaatgttatcctgattttatagacgagatagtgagtttagaaaggcagtatggtggaatggagcatagatttggagttggctagacctaaagtccagattaaatctctgctcaaggctgggcgtggtggctcatgcctgtaatcccagtgctttgggaggccagcgttggcagattgcttgagtctggaagttcgagaccagtctgggcaacataggcagaccctgtctctacaaaaaaaaatacaaaaattagtcgggtgttatagtgcgcattggtagtcccagctactgaggaggctgaggtgggatcacctgagactgggactttgaggctgcattgagctgtgattgggacactgtactcctgcctgggtgacagagtgagaccctctctcaaaaataaataaataaatacatccccgctcagccacttatcagttacgtagatacactgcctaaccttagtgaaccctgtttcgacaactccaaaatgggagtaaaaatcctaaacttgtacagtggttttttagttttgttaaaagtacaggtgaggtttttttcagagtattggttgccatctgagagtgatcccctttcacctcctctaggacttttagcattttctggagacattttggtggtcacagctggggtggtagagtgtgctattggctaggggcttgaagccagtgatgctgcttaacatcctatatggcacaagacccctccccatcaacaaagaattatctagcccaaaatgctgtgtaaaatgtctggtatataataagtataatatttgatgaaaatcagtacctttgcccccaggtgtgatatttaagaaggtcaacttactaaatcagtgatggagttagtcctaacatctgggtgttctgactgctgctaggccagtattctttatatgataataagaactttgtccacagaagatatccctaataacaaaaaaggtttatttgaagaggactcatgtgttctttggctgattgtgaaagtgttgctttgaacttctgttagaaaaggttgaagatgttttccgtaagtgtttttaatactgtacgtagtattcagaaggatgtttaattttttttttaattttgctagtagtttttaaagtaatcctttttcctttaattatgtagttgttgaactgttgggagttacttttctcttactattttgttatttaatgtattctttgaccttatgcttttttattctaaagctgcttttattatagtcagatatgatgaagttaaatgtacaatgtaaaattgcaaatttccaacgagctatacaaacttaaatatttctaagtaaagaaaatagggctgactctaaggttctttgatccatgtgttgcattcttttctaggccctaaatttgctatgccagcctgttgaattaaagtgctttatttatctaaattagaaacttgtattaaagtgaagttttagaaaaaaagaaacaaaatcggaatggagttttaggttagcccagagatgggaagatgccaagaaggtagctttagtggattctgaattttttggttttgttttgtttttagggcaggcaaatgtaattacaaaagggttctaggaatagattgctgtgattttttttctgtttgcatgattttacagtttgctttgcctctcacttttgaatgcagaataaaatgtcaaggccttatttttttttaaattcttaagaaatttaagatttgactgttaattccttttgaaatatgggatattttgagataccaattatttaagacaaataggactcattgttacaattcagttgaataaggcttatgatgtttatttcagtatatgaatgaaaactatgtgcttattgtacttaagaaaatttcttttattaaaaacatgactaaagagaattttaaaaatcacccactgtcctacttctctaaaacttaatgttttcatattagcttccagttttgttcatatgcatatactttaaaacctagttcatggtgaacttaagagggtgttctttttaaaaaacaatttccattgcactttgtcgttgccttaattaaatggtgaaatcatcagaaatatttattttcctatacttatacatttattaagcttgtttccatttttttattttgtgattttttaagtggatttaagataacctaaacattagagaggattttcatggttttgattcatgaaatcataatgttatacaaacctaactgaagtgttagagccttgaagatttttcccccgaattacatatagtaactctacttgtatttaatactgaaagcatattttacttatttaagtgagacaaagtaaaatttagctgaatactttagatctatcatttccttttcctgttgtaagaacattacattgtgttgaaattaaagtggatatagaaggtaattagaataaactgccacatcatttttatagtaaagtggtaataacactattgctttctgtttttttaatcagaaggagtatgggcttataatgatgttactgttccctgaagcatattttgaatgatacggtttatatttgcacagttgcccaggtaatcattgtgatattaattgatcaatttgctatttatttgcgttttaaatcagtactagtatttgtgcttaaaaattttgcatatgttttatcagatttaatttttaagtgtcagatactaaaacaaataaccttaactttattaaattataattttttatcatgaggtggtattcatttattcatatagttagaacaaaaaatatttaaaatattgaggtagaaacaaattagtctctttttaattaaaagccagattacttgttagagtaacattttcccaaatgaggtaaaattgttgcgactgttaaacttaaggaaattttgatctaggtgtggtatataccttcttgtggggtgctaatgaaaacagggatggcaaaaatattttgtttgtgagtgtatgcatttatgctttttgacaacctaagaaacactcttacatctgagtatctttcatggactagctgtaggaaatctatataaaatagcttagtatactgaaagtatgacatagttttacatatctagattgtggttgtgattatatataatactataaaatatgctaacgtgctgcttaataatactatttggattttttttaatactgaaaaggtcacacagattgtgattattgtgtagtgtccaagaactaaggcctaccatctgttactcaaatgtatgaaaaagttaagataatttagtgatataagtggttttgacaccactgtttttggaataatctaattatgatttttataaagactaatatcaaattttaaacgtttgcaaaaatgaaacctaatagttatactgttatttatatttttctattacaatacagatactggctgagaactaaagattgtgtaataaacgcctggccttcagtcatttggttttttttttccctcgattgtttggatagttaactggacatcatgttttaacttgagaaattaagttatacaagattttgatattttaaactagttttcctaactggttgagatatataagaatttagtattacaggactcaatcagggaactgatttaataagaatttcttaaaaatttgtttaaatatttttcaagttcttttcttcatcttctacaacttaattcttgtctgtatgcaaatgagcttccccatttaaaattttgctgttgcattttaggccactatagaagttgtttctttaattttcactcacaagaatttggtcttaccaaattgtgtaaatctttaaaattgtgtatttggcttaatattatagaatctgattgatttaatctaccttgtttcatttagtatgttgacattttcttgagaaatttgttatgccaaatgattaacataataatattttaagtttagatatgattttgaatttacattttcaaatgcaactttgtgtctgtggccttttttttttttttttttttacgagaaacatcttgccaattttcagattaatctgtgaggaaagtagattggtttactagactcagtttgtagactttggtgagaactgaattggaggctatgaaaaaaataccttttgggcctttctgaatagacatatatacataaattatatctcttacattaagtgaggcacatatgtaggtgagatttttacctgaatattaaaagtttaaaagtcgttacctattctgtttacttaatagtatttaaagggtgtgagaggtgttatgtgtttctgtcccttgtttttattcctatccctcccatctaactgttggtactcttatcttcccaggtattaaacttgtatgttttaaaagcttatttacttgttgaaatggttaacttaattagttttttctttgaagtttcagcctaaatattttctgtttttttatatgtcctttaaatatgaaaattctacagctaatcataattagtaattgtactttttcccctattacaataactggtttcataataaaatggtatcccttcaataacaagcatttatagtagtttattaaaactaagggtgttatctattcaaaccaagcaatgcagacttactgttgactctgttaatatattttaaaattgcatattactaaaatttaaaatatgattttgactagtattttggtgtatgttattttagatattttgattatgcactacttaagaatgaattgtcaagtatgattataaagttgatataatagttaaccttcagtgggaataggaatcatttaatattgttagatatttgtattattagaacaatctcctatgattcttactaatatagtaatgaatgacagacaatatgttggctttcatatttaaaaattcacatgcatttctagtttatgtttttcttcgactaaaattctgcagcacttaggcaaagctatttttaccagttggaaaaaaagtaagtcatttccaaccaattttcctggcttgtagtatagaataaagagacttgattttattacattaaagccaaatataaaatgatgcaatctagcacacacttgtttggaacttttctcttttaaatattcagattaagaggacgttgaaaggtaaatttttttttttttttgagacggagtctagctctgtcacccaggctggagtgcactggcacgatttcggcttactgcaagctctgcctcccaggttcatgccattctcctgcctcagcctcccgagtagctgggactacaggcgcctaccacggtggcgcccggctaattttttgtatttttagtagagacggggtttcaccgtgttagccaggatggtctcgatctcctgacctcgtgatctgcctgcctcggcctcccaaagtgctgggattacaggtaaattttgattgttattagcaactataaaagttttgcagttggcttattggaaaaagaaaacctccttgccggagacggagacgcatttgtattagaactttgttttctgagtaccttacctatagtaggtttcaaatattggtgaattagttgatggttaggtctgcataattactgcgtatggaaattctggaaccctattttttcaaaatgcagctaatgttgagagaatatgcactaaatattactagatctttgtttttcaagatgctgatatcccttaacatcttctgcactttacctgtttgaatatcttttttgctgtaaaaattagtggccttatgtctttctgcataattatagagtagccaaaacctgttttaggttaatcacctctggcaaaataaatgataaaagcatagcttttgtaagcagaatgatattacagaagttaacttataaatctaagtgtattaaagacacttaggaaatttatgataatgctgggtcagcattacagttttaactttttacagtttttcatatgctttttttgtgattttgctgtagaaaattaacagttggcatttggcttagttcaagtataatgctgttgacaagtatatctgacacgtcattgaactaataatatttttgaaagctgataggtaagttatatctattttgtttcattcgtcattagtgatcggtcttagatgtttttagcgagagcaaaactgtagaggaatgtgtgtctgtgtgtgtatatgtgtgtgtgtgtgtgtgtattttaacagcaggagagttctgaaacaggaaaccagtcttatcatattcatccagagacctaggaagaaggtaattgtttggtatactcgttaaaaccagttggttgggcaacttaaatttttagaggatcacagatgtaggcttgagcagttgtagatagatgatttctttttttttctttcttttttcttttttttttgagatagagtctctctctgtcatccaggctggagtgcggtggcgcgatcttggcttactgcaacctctgcctcccaggttcaggcgtttctcctgtctcagcctcctgagtagctgggattacaggcgcatgctgccatgcccggctaattttttgtattttagtagagacggggtttcaccgtgttccccaggctggtctcgaactcctgagctcaggcaatctacccacctcggcctcccaaagtgctgggattacaggcgtgagccaccgtgtctggcgatagattatttcataattaacacctgctatgaagaaaaattgattaaaatagttgagaagtctagtacactctcagctaatatactaaattatactatggattttagagtattgttaacattatcagtgacttgatatcttcctgaggttctaatttgcttaactttaaataattggggttcagatcaccttgattgttcccttaaagattaaattttgtaaaactgtgtgtaattttcctgtatctggtttggatagctttaaaaatggttcttaagtttaatgagttcaactgggaaaaaagttagttctattttagatgttgtgtcactggaaattatgtttccctgtttgttatatgcacattattacaaagttgtaatcaatgttttcatactgttctctggtctgtttttttcacaaatacactttttatttgtcgccaggtacttatttttaaagctatagaggtaatatttcatcaggtgagggtaactaccatggtttgtttgctatactgtgttagggttattttcgttttttttttcttttataaactatagttgtgaatatgtttatgtagtttacttttggtttattagaatatattgctagagtgggattacaggattaaagagtgtacagtattttagttttttttttttttttacaagttgcagatttgttgccaaatgaacgagtttgtagtattgctaacaaggagaagaattactagcaagtcttgatgttacttttgaagagtgtgatgattgcatttaggaagatatctaaacttctgtttcaaagcaaaaagtatgtgcaaatttcttactcatgacaaattcatataatataaaaacatgaaagttgtgaggtcaggttgtttggagaagtagaaaacttcagtagagtttatagataggcagtcttcctttctggtttggcactgacagcagattaactagaaagtgttagaaggaacctaaaatttatactaaagtcaatttaagttaattaatataccagaattccttcttttacaatttatttataaaaacaccatattgagttgccttgtaatgagacatttaaactaaatttaaataacagaattcatgcaccatctaataacaaccccttatttacaattatagagtcctttgcaattttatagatattttcatgtatcccatttggtccttgaaacaattaatgaagaagttacagcaagtggtattatcattattttacagaagaacaaaacaaaaatatatgtggcccagagattgagtgatttacctgaggttataggctttagattgcatagctggaagtagaaccttgttcttctatattaaatgacaatattcattaagtacttagcacaggatttggtacctagtaaatatttaaatgttcctgtgttattcctgactattccttctttattcttaaaacgccattttttgagcactcttaatatttatagttcaaactttgtacctatgtacctttttctctttagaaaataagatttcaggctgcattaatttgatctgtacaggaatgattatatgttttacatattgggacaaattgctctttttttatataccttaagctctagggtacatgtgcacaacatacagatttgttacatatgtatacatgtgccatgttagtgtgctgcacccattaactcatcacttacattaggtatatctcctaatgctatccctcccccctccccataccccatgacaggccctggtgtgtgatgttccccaccctgtgtccaagtgttctcattgttcagttcccacctatgagtgagaacacgcggtgtttggttttctgtccttgcgatagtttgctcagaatgatggtttctagcttcatccatgtccctaccaaggacatgaagctcatccttttttatggctgcatagtattccatggtgtctatgtgtcacattttcttaatccagtctatcattgatggacatttgggttggttccaagtctttgctattgtgaatagtgctgcagtaaacatacatgtgcatgtgtctttatagcagcatgatttatactcctttgggtatatacccagtaatgggattgctgggtcaaatggtatttctagttctagatcactgaggaattgccacactgacttgaactagtttacagtcccaccaacagtgtaaaagtgttcctgtttctccacatcctctccagcacctgttgtttcctgactttttaatgatcactattctaactggtgtgagatggtatctcattgtggttttgatttgcatttctctgatggccagtgatgatgagcattttttcatgtgtctgttcgctgcataaatgtattcttttgagtagtgtctgttcatatccttcgcccactttttgatggggttgtttgattttttcttggaagtttgtttaagttctttgtagattctggatattagccctttgtcagatgggtagattgtaaaagttttctcccattctctaggttgcctgttcactctcatggtagtttcttttgctgtgcagaagctctttaggacaaattgttcttaaataatgaacagttggcactttttcaactggaaaattcaaggaactgctctttctgctttctgctcaatatgaatcttcaatttagaaatgagagtccatcattaacaattcaacatagcttattaataggaaaaaaaaacctagtaacaaatgtaaaatctttgattaaatgagaaagtcatagaagttcatcagatttgtatttaaagcatgatttcattagaaaagttgataataaggatttaactgtgacataattggaaaatacttgtttaaacttaaaattttgaaaagaaatgtaaatgtgatgtaacttatgaatcagtggttgagtttcttttttgctcacaagaaccctaactgtgtgttacttgaaagcactgatggaaatcagggaaaaagctccagaagttcctacgaaataaaattaaatgataaagtcctggtatctgctaacttgccttccattcctgttatcttttcttcttagtctgacttcattaattctttcaccctggctactggtttagctcagtgttttatgagccaggcagcttcagactttgcttttgatgctctttgttcattacctctaaagctgtattatcactttcattttatcattaatgtttcatgtatatgttatagtttcatattgttactgcaacttttacttagctataatttaaaaaatatctgtgatctgtggaaataattattctatggcagaaaagtagttattgcattttactttataagttgtttaaggataagcatacctatatattaagcactacaaagaaacttttacaatggctttatttttagcaaaccatcatagttaaaataagatttagtgtacatgtcaggaacacagtcttatgaaataaggtttagggagctatttttagttactatatcctacttgaaaattgtagttaaatttctagcatataccctattaatttagatgcaagtacagatttgagataaggtagatacattatttggatgtcaactcggaagttgttcaagaaaagatattttgttatttagatgtaacttggaacatatttctagtgtttcaagtcatgattgtatgcctagaacaggcaataaaaatttacttagctggtaaaacagccacattatttcaaatatagtttagttatattatggattaaattgatttttgtggacagactttagaacttaattgctattaattacattttttctttgggacggtatttgttctttggtgagaaaggattcttgtaacacctaaatcaagactgtccaaacatggcatatgcagtttaccagtcaaaacaaactaatcacttaagatctgtgtattttgttttatttgaattatacctcaattaaaacaaatttagcatgtttacacaaaggtggggggaaactgtctaatatatctgagatctgttggagctggggtgaccatccaacttaggcaagatagctagtaccatgtatgcatttcttttacctttcttattgtatatacagtaatcactgatattatgagaaaaagaactttttaataattcaggagatattttatcgctagtatatattgagtgcttattatgtgccttatatactttggactcatttaatcctcaacacaacaaccctatgtagttcatactagaattattcccatttaaagatggggaaagtgatgtttagagaggctaagtgacttgcccatggccaaagtattagaactgggatttgaacacaggtagcctgattcctaaataaatgaccactaacattaaaaagacataaacatagaggtgtttgttgcaatgttagtcataatacctaaaaattgtgaactagttaaatgtccaatagtagtaaaatggttcattaaccatggtacacccatcaatataatgttatattgtcatttaaaattgtattcccaagtttcgtatcaggaaaatataataaatttttgaaaaatgtaatgggatatattgtatttataatacagtaatcactatgtaaccaacatttttatttccatcaaaaattagttataaagaaatagaaatctaagaagtttaatagatattaccattgaacactagatttgtattagtatcttttatatttatctctctcatttcctatattggccatgtttacttttaaaatagtaaaagtcataagctctattttaaaaataaatgttagtttattaacccaagaataatagctaactataaattcatatttgataaaataaaaagatgacattcatcataagggatacatacctgtgctagcatatggcatttttaaaatcacatgagtaatttgtaatcatcatagaaatattagaaaatacaaataagcaaacacatactgaaaatttagtgttcccaaatctaaaacagagacactgtttttttcttttgggattgtattttagatatgttcttaagttataataaagtaaatacttaaaaggcaaattgatacattaaggatttcaaagagtaaaactttttgttaagctttgatgttctttagaaagtttagattattccacaagtcactgtcgttgaaagaaaagtagttacagtggggtcttatgggataaggcattaccatttgttcagttgagagacagctatcactatgttttaagcattgttcatatattagctcatttaatcctcatagcaaccttatatgataggtacctttattagccccattctgcttaggaagcaacagaaagagtatgtattttgcctaaggttgcacaataagttaagctggggttccaattctagcaagttggttctagagtgtatgttattaaccattatgccgtagtgcctgcaagtagatctctagatgtcagaaatactcatcttcctctggttacctggttgttataaatctttatgcttaatacttatgtcattatatgtaaatttcgtattaaacactcaacttattcagaagaatatcaggtaagtgtaggttaaggctgttttctatcagaaatcattatatgtatatatattcctcagttcttatgttgtttagtttttctaaaatgtcaaattttataatatatggagaagtataaatgtatattagaaagattttgtttatttgtgtaatttgtggcataagaaatatttgcctcaagatttggtgcttgtttaggtagttgctggcattacttttggaaatgtcagtaaattttcatactgtcttggaattttttcaatttttacattttattagtaaatgtaattacaggttagtaaatcacttatttgaacctgtttcctttgaaagttttatatttttatttggaaatagaaaaaccttaatttcctctcgttgggcagtatggtgtcaaaagcttgggctttggagcttcgtatataatctgggttcaaattataacttactagttactaacttgggcaaattacccagtctttttgactctcaatttctttgtctatgaaatgtaatactatttaggattgttaggattaaatgagaatatatttggcatactgtctggtacatgatacttaacaggtactagttgtctacatctttctaacttaggatggatgccgatgtcttgggtaacatctcaaactttatcagtaaggaaggtgagaatctgaagaaaatgaaaccttaaaaagattgaattcctggactccatttaaaggagtaaatagctcacgaacaagacttgctgctctgcaaagtcttccatgttgatcctggtctttgactccttatctgtctgattaaattgaattcgctgccgtggcatccttaaagctggaccttactttgtcagtcctgccttctccatgttgctttgtgtgtaagcttcactggactgtttgctttttgctgattattttatgtatttccatatgtctactttagcctttgcttggaatgttctaactgctcttgtttcttcctctgtttactggtttctgacttaactcttaaggattatctaatatattacctacttggtgaaggtttatctgtgtccccacagaattaatccttccctctttaactcttaagctatcttattttttatctaatcgggtctttggcacaattataggtctgtgtgtctgtcttccctaatagaataggaaagccttgaggacagtagtctttgcttacttagccttatattctcagtgccccttgtgcaaaacgttcaatatatgtttgaatgattatgtgaatgaaggagggggccagctgaatttactttaatgattatgtaacacccatttatgtatagttatagacttgtctgaaatgagttaaatcctttgcaacgtttgctgctatgctttgaatgtctcttacaaaactcatgttgaaatttaattgccattgtaatggtattaagagatggaacctttaagaggtgattagataatggtatctctatccttatgaatggattaatgctgtttgaatggtagtggatgagttatcttgggagtttggcctcctccgtctcacatgcttccttaccttctgccatgtggtaactcaacacaaagatccttgccagatgctgatgccatgctcttggacttcccagtctccagaaccgtgagccaaatacatttctgttcattctaaactacctgttttgtggtattctagtaaagcaacataaaatttactaagaaaactggtaccaagagtgtgattgttgccataacaaatacctgaaaatgttcaaatggcttgggttctggctagagaaggatggaagagtttggatgaacaggctagaaaaagcctgtattgctgagaatagagcattaaggacaattctgatgaggattcagaagaagagagctgtagggaaaatctggaacttcttagagagttgtcatcagttggtagaactataagtggtaaaggtctttctgatgatatctcagaaatgaagaacaagatactggacactggagtaaaggccatccttgttaaatagttgcaaagaacttggcgaaattatgttcatatcctaagactttatggaatgcagaatttaagagtgatgaactaggatatgctgcagaagaaataactcagcagcagagcatttaggttactggatggctacttttaaccacttaaactaagctgggggaagggaatgacttgaagacagaatttataattaaaagagaggcagaatggaaatacttggaaaatttgcagcctggccatagtaaagaatgcaaaaggtatgtttaggagagcaaaccaagggtgtggtccaggaaccatttgctgaagagattaatattcctagaggagacccaagggctatttatcaagacagtggaaaaagaccccagaggcattttggagatctttgaggctgcctgccccatcacaggcccagagctctaggagggcagaatggtttgtggctcaggtggtccttcacaagcttgctgcccagggctacctcagctccccatatttcaacccagtgggccttggctgtcctaggtctggttcagaggggcccaggtgtggcttaggctactgctgagtactcaaatggtaaaccttggcagcgtctatatggtgctaattctgcaggctcacaggatgaaagagctgtgggagacatggctaccaccaccaggatttcaaaggatgatggggatagtctgggagagacttgccacaggcttggagcctctgaagggtggaaatgtgggttggagtcactacagagagtccctactagggcattgcataatggagccatggcagcaggcccaccaccaaagcttcagaactgtagagctacaagtatacagtgccagcctgggagaacttcaggcttgagaccctaacctgtgaaagctgcatgggctaagtacagcaaagccatggaggtggggcttcccagggtctattgggatgaaacgaatgtattttgtaggtgagaaggacatgagttttgaggcccaggggcagaatgctatggtttggttgtttccttcaaaactcatgttgaaacttcattgccatgtggcattattatgaggtggaacctttcagaagtggttacattataagggctttgccttcattaatggattaatgccattattgcaggtgtgggttagttatctctggagtttggccccctttttctctatcatgtgctcatgccctcttttgccatgtgatgccttctaccatgttatgatgcatccagaagactctcaccacatgcagccccttgatcttagacttctcagcttctagaactgtgagtgaaataaacttcttttctttataaattaccccgtctgtggtattgtatagcagcagaaaatagacatcagcctgaagttcccccaggctggcattaaatactaattattaattagtatttatagtgcaaggataaattcaagtttagccctggttagaatgaccacatttcaagggaggggctttgtacttctgtgcatatctgtaaggataaaaatcttaatactattctcactgaaattaatggtttaggttaggtaaggttgttagtgctaataattatttcttttaataaaatattcttagttgcgttgttcaaaaaacatagatgatttgaatttatattttttggccaaaatatatttataattttgagtaggaattccagagtattggtagctataaccactttgggttccctgccattgcttctggtgcctcattttttctgacgtcttccattttcttacatttgtcttctaaggtggagttaagattactcagttaagattatttcactttaggcctctgctgtcttctgcttttttttttaaaatgaatggatataatatcccaatacattttgataattgaacaacagctacatttttaagtgaggctactttcttctaattttttaaatttatttttctcagtttttaaaaaaaatgtcagattggctaagagttggggcagctttcttatgtgagagtagtagatgacagcaaatatttgtgatgttaaaatgataatcctaatagttttcttttagaatctttataataaaaaccctttgaggctgagggtgaatttgtatgttcctaaagtgacaaaaaatgttcttggggcatagtaatttaaatcttagatgcttttattagtataattttttggtagaaatttggcattaaaaaatgcatacagagctttttctacatacagggcaagacagcattttgtcatggcaattagtaaatagataattataaaacatctaattttaagcaatttgttacagaaacgatacaggtacattgtggcaaaaatagaagatacaaaacaagcaaatatgagaaaaaatatacatgccaccacctatatatgacttttagtactttataatcttttgtctatatatgtctatatggatatatacgtattctttttatccaaatggtattacattgtacattctgttttgaaacctgccttttttagtcatttacatctacttttccatctcagtaacttttcatcttgtgtaatgcccggatcacattaaaatgtttccaattagctcaaaaatgtcctttatggctggtttggctaaaacagtatccaggccagcattgcacctatgaaattggctgttaggaatcttgtatctttaaaaatcaagggcagcaacccatcctcccgcttcccccacctcccaccacccccccaccttttttttttcttaaagatactggcttgttgaagagagaatgggtcatgtcctacaaactgtctgaatttgtccagtttgctgtctcatagtgtcatttagcttgttttatcctatgtatttcctgcaaattaaaatttgtatctgaatccttggtggatttgagttgaagatccttaaccatcatagatgatgctgtgtcctttatattgcatgtcagaagttacatgatctttacttgattcatgatgaggagatggccactgaaattggacagtgacagtcttttctgcccattgttcaattatattcgtctctttacattagaaagtattttgggtagtagtattttggtgctgtaagaaagttcattttctcatcaaccactcacctattggtttaacaccatttgttgatctttgagtatatcagtaatttcatcagggtttgcaaaataagactttaaattctattgttttacattattaattgatgttttttgataaggtagaacttgtgaaatgggactatttgtttgtctttaaatacagtctctataggaaagacaaaataaatacttaaatctcactctttaccatttttcaaagtgaagaactattccgttaaccacctcaaaagatgataaataaaaagggtatttttagttgtttcaactttttttttttttttgagatggggtcttactctgttgcccaggctggtgtgctgtggtgcaatcatggtacaccgaagcctcagtctccctgggctcagatgattctcccacctcagcctgggactaaaggtgtacaccaccatggccagccaatttttttgtattttttgtagagatggggttttgccatattgcccagcctagcctcaaactcctgggctgaaggaatccacccatctcagcctcccaaagtgctaggattacagacgtgaccaacaatatccggccttaacttttttcttttgagtgtctttatagactcaaggacttttatttaattcagggtgttagtaccatttaaatgttttctttgatgctcagattatcacagctagtcatttggacctttataccacctcctatgtccatttgatataggccattaatctctataagccttcctccttctcttggaatgaaaaggtatcctaggctcacctgtaccttccctactccagacctggcattaagtctttttccaaggagtttggtaccttttagtttattatgatattagagatgaaaatctgtgttctaggaatgtttattactgctagagtgatgttgcttttaggccatttcagagaaaagacctagaaaacagatttttacaaacatgaattcatactgatatttttagttttttacatgatttcttgattttacaatattatctgctttcttaacttaaaattatgaaccttaaagtcattagcataacttctttgcttatttctacaacataaagaaaatagtcctggtgcggtggctcacactgtaatcccagcactttgggagattgaggcaggtggattgcttgagctcaggagttcaagaccaacctgggcaacatgatgaaaccttgtctttacaaaaaattagctgggcatggtggcatgtgcttgtattcccagctactcaggaggctgaggtgggaggatcacctgagcccaggaggtcaaggctctagtgagccatgatcatgccaccacactccagcctgggtgacaaagtgagaccctgtttcagggggaaaaaaaagataaaatagtttgaggaggctggatgtagtggctcatgcatgtcatcctggcactttgggaggtcaaggtgggaggatggcttgagcccaggagtttgagaccagcctgtgccacatcatgagacctggtctctatttaaaaaaaaaaaaaaaagaaaatagtttgaggatatcaataatgatattactagaatcagtaaaactaccaaaagaagtttaaagtttcttcctagtgtttttttgttcttagaatacttcctaccaagaagtgcagtaaaagtgcagtgtccaaatagcccttgtaacaaaacctttctctttctcctgggtgccaatttgacatttaatcagttttgtttctagcagtgttcaatttattagattataagtcttttttttctttatattattctaagatcaaaaatatataaagatatacacaggagtcctgctgctacctgttcttgctatgcttttccccttttcttccctttctctgtgaagcagccatttttattagtttcttgtttatcactcatgcatgcatatgtttattgaggatgttgacattcaagcaaatatatgggttaacattctttttgtcatccctatacgaaagatatacccagtatactctattgggtgggtttttttccttaaaatattcagtagatctctccagttagcacatagttatcttatagatagaacatatacatataaccttttcttaaactatgctattaaaataatagctttcagtaacttgataattatttttggattgaaaatactactgaaatcaactcaatcatgtgaaagctgcagaaagaaaaagacctagaaaaagggcattggattaggtcaactttgaattttatttggaagataaatgagtccagaagtgagtgggcagagattattggagttggtcttgaaatgaggcgttaggcagattgactgggctggtgtgaaaggtctgtcagaaaatcatgagattagattgaggtacctcaaaaaatgagagctggtatgatgagtgggtaagaatcataaaagcgtagagtgttgatgatttttatagtttataaatggttcttgtgtgtagagttttgtttttatgctagctatagtctgtaacataattcactataatgggcatgctaaatatccatgacagttgacccttgaacaacacagagggtaggggcgcctacccctgtgcagttgaaaattcacatgtaacttttgactccccaaaacttaatatttagcctatacttgactagaagtcttactgatgacataatgttcgttaatacatattttatatatgtgtcagatagcatatttgtataataaagtaagctgcaggaaaaatattaaaatcataaagaagagaaaatatacttactattcattaagtggaagtggatcctcataaaggtcttcatcctcactgccttcactttgagtaggccgaggagtaggagagagaggaaaggtcagacttgctgtctcatgggtggcagaggtagaagaaggtccacatacaagtggtccgacacagctcaaaccggttttgttcattggccaactgtagtttgattgaaagtaataataaatgaagtttctgcctcagttcagtattatcaagtcatagatagcaagggctggaagaaaccttagtagtaatctctttgagtctaattatcatgtagaataggaaattgcggtctagaaaggttaagtgacttgtccaaattacacaactagttagagacatagccagctcttaaatctgacttccagattttcactgtgtcttcttttttctgtaacgtgttgccttttttagccatgaaaaattagaagttgaactcttgtcttttcaggcaggtgtcaattttggggttttgttttgatttttggtttttgacataaagtactttagttctgtgatgtataaaccgtgagtttctgtttttctcatatacctgaatactgtccatgtggaagttaccttttatctttaccagtattaacacataaatggttatacataaatacattgaccaccttttattactccagctatagtggggaaaactttcttttcataactagctaatgttttaaaaagtattcttttagtttgattgctgcatatttcagatatttctttccttaactaaagtactcagatatttatccaaacattattgctatgggatttcctgcagaaagacttgaaggcgtatacaggaacaatattgatgatgtagtaaggtaagaatgctttgattttctatttcaaatattgatgtttatattcatgttgtgttttcatttagaaaagatttctaagccacagaaaaagatactttgtgatgtaaactattattgtagtgctctataatcattttttggcttaccgtacctaatggacttcagggggatacagttcatttgataagaactgaccttatacattacataatcaggtacttatgtgatatcatttcctggactccataaaatgctggtcaccaggtttaatacctggattccattacagtgtgatttttgtcttatttcatagttggggattaggcttaaaatcctagagtggatttattcagttaaatttattcacactaagatgtagatgactaatactgtatatttttatgtagaccaaattttaaggtaccactgtgcatatgtataccaactacctgaagaagtatttggttggtacaagagatatagaaaggaatcgctgggtgtaccaaggctaatcagttttataattttgcataattttctaactgcgattatcatttagtttagaacaatttatttctcaaggcccatgtaaatattatttttaaaatatacagtcttaagaattcatggcatattttatgaaaggaggaattcatgtctgatgtgcaaatagtcttaacatattttctaatttcagagcaaaaatatatatgtatgaataaattaactgtaaattgtcagtaggaaccttaagaattcgtggcgtattttatgaaaggaattcatgtctgatgtgcaaatagtcttaacatatttgctaatttcagagcaaaaatatatgtgtattaataaatcaactgtaaattgtcagtaagaaccttaatggctttaaaagttaaaatttcaggtcaagcattgtggtgtgctcctgtagtcccagctacttgggaggctgaggtgggaggatcacttggcttgaacccccaggtagagggtagaggccagtctgggtaacacagcgagaacccatctcttaaaaaaaaagtttaagttgtggattatttcctttacactctttcattagtatctttcctggagactttcaatttaaatacttggtgcttatgacaattagatgttaaaatggatgggaaagtactttgtaacttataaagcattatgcagatgtagactccttttataatagttgtgtaagtatataagacaacctacattcttcatgagctagccataagttttagcaacttgctttgaaccacggtagatttacaattttctgtagtattgagttgtgttcatttagaattttgtaatatttatattgaaaatcaaatttttgtacctacaaaaactacaaaaaatccccctagtttttatagtttctattaaaattatagctggtacatagggatgccagaaggactgtttaagaagctgaaaatagagaaatgaatttatcttctcatagttaggcagggcacagtagaaggatgcttaacattgcaagctgatgggaacagcaggttgatatagcttgtgataacacttctaaagaaaaagcaatgagccatagaaaaaagaaaaagatacattttgaattaaggaagatggtgaatctgggaagtgagcagtacagtcaccagacgtgtatcctctcctatggtacagaagtgtttattgggtctctttatggcctgcatgatatatcccacaagatgacctacttcacattattttaattctgtattcaactaagcactaattcaacccagccagattagtactcataccaaaaaagagtgaatactctgaatagagggcaggttttctgattatggtgagaatatctttgtggtaaattaatctggtgtgctagtttttacgttggtctcttctcagtgtcgttagtcactgaggctgattgatcatcttttaggttactgataaagttcctgtacagctgattttcagaccttagattgcaataacttcaccaagaaaatacttcattgggaagcattttggtccttccatttgattcataactcttacctttatgcctctgaaggaaaagatttatacattcagcttgtaattagtaatcaagactgaggtttagtctatctagcttcacaatctatctagtttgttttgtctagccatatgatttcttcaaatatgccatttcttaaaaaaaaatgttttatgtatcccgattaatatttagccagtggttcttttagccgatggatcttgtcacctcttatgatactattaatagcatgtcaacatgaagaattatctgctgaatataatagctatgctgtccttgtttccttttgtctcattcttttttgattgggggataattggccaataaagctttgatagcctctattgcccaggcccctcctcttcttttatgagagaaaggatgaacagtgaccagaaataaaggtattgtttttttctatcaactaaaatggaaataaataattcctaagtaatttgcctgttaggattaaagtctccaagagaatggctgtgcctagtacctaagtgattaatttccttgattggttcacattatattgaggatattagtaatcagtagtgattccttttttggttcaaagatgatagtgtcacagtgaaaaatgtttttaaaatttttgtatacttaatttttctgttaacgaaagtattttcagttggatttttgtttgccctctctattagaatgcccaaagaatatttaaaattttccttttctcttatactgcatatttttcctgtgatttttccccaaacggaaaatactctgcagagattagactttgttattgttgtactacatcattgctttgactaaaataaactcagattgcaaataccttcaagcttacattgctcagtatttttttttttttttttttttgagacggagtctcactcttgtcgcccaggctggagtgcagtggtgccatctcagctcactgcaacctctgcctcctgggttcaagcgattctcctgcctcagcctgcggagcagctgggattatagatgcccgcccccacgcccagctgatttttgtatttgtagtagagatggggttttaccttgttggccagtctggtctcaaactcctgacctcgggtgatccatctgtctcggcctctggaattacaggtgtgagccgccacgcctggctaaattgatcagtattatttaactttgagggatatgatttgttatggaatgcgaagttttatacttgaggtactcagagtccttttgagacaaatatttaacttctccttttgaggttaccgcctacgattgggaattaatgtaaaaaataagccaaaagaaagtgagggaaaagtgaaccaagctgtaatttttttactcttttttattgttgttgttattgttgctgttttttactatcttgattgcaacagtttggcttatatatatagcatttggaattgacagtaagaaagccacatctcatagaagctaactattcccaaattgtttttttcttcttttcctcttactactgctgttttcctcctttcttgctgctaagctcttgtcctgacatgctggtaatatgaaacagtgttttattcagataattgattattctgtaatatgtatgttaatcttttttattacactttaagtaatagggtacatatgcacaacttacagattcgttacatatgtatacatgtgccgtgttggtttgctgcacccattaactcgtcatttacattaggtatttctcctaatgttatccctctcccaaccccccaccccaggacaggccccggtgtgtgatgttccccgccctgtgtccaagtgttctcgttgttcagttgccacctgtgagtgagaacatgcggtgtttggttttctgtccttgcgatagtttgctcagaatgatggtttccagcttcatctatgtccctacaaaggacgtgaagctcatccttttttatggctgcatactactccgtggtgtatatgtgccacattttcttaatccagtcagtcattgatggacatttgggttggttctaattctttgctattgtgaatagtgctgcagtaaacatacgtatgcatgtgtctttatagtagcatgatttataatcctttggatatatacccagtaatggaattgctgggtcaaatggtatttctagttctagatccctgaggaattgccacactgtcttccacaatggttgaactagtttacagtcccaccaacagtgtaaaaatgttcctgttcctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtctataaatgtcttcttttggaaagtgtctgttcatatcctttgcccactttttgatggggttgtttgatttttttcctgtaaatttgtttaagttctttgtagattctggatattagccatttgtcagatgggtagattgcagaaattttcttccattctataggttgcctgtccactctgatggtagtttcttttgctgtgcagaagctctttagtttaattagatcccatttgactattttggcttttgttgccattgcttttggtgttttagtcatgaagtccttgcccatgcctatgtcctgaatggtattgcctaggtttgcttctagggtttttatggttttaggtctacatttaagtctttaacatttaagtctttaatccatcttgaattaatttttgtataaggtgtaaggaaatgatccaatttcagctttctacatatgactagccagttttcccagcaccatttattaactagggaaccctttccccatttcctgtttttgtcaggtttgtcaaagatcagatggttgtagatgtgtcatgttatttctgagggctctgttctgttccattggtctatatctctgttttggtaccagtaccatgctgttttggttactgtagccttgtagtatagtttgaagtcaggtagtgtgatgcctccagcttttttctttctgcttaggattgtcttggcagtgcgggctcttttttggctccatatgaactttaaagtagttttttccaattctgtgaagaaatttattggtagcttgatggggatggcattgtttctataaattaccttgggcagtgtggccattttcacgatattgattcttcctacccatgagcatggaatgttcttccatttgtttgtgtcatcttttatttcgttgagcagtggtttgtagttcttgaacaggtccttcacatcccttgtaagttggattcctaggtattttattctctttgtagcagttgtgagtgggagttcactcatgatttggctctctgtctgtctgttattggtgtataagaatgcttgtgatttttgcacattgattttgtatcctgagactttgctgaagttgcttatcagctgaaggagattttgggctgagacagtggggctttctaaatatacaatcatgtcatctgcaaacagggacaatttgacttcctcttttcctaattgaataccctttatttctttctcttgcctgattgccctggccagaacttccaacactgtgttgaataggagtggtgagagagggcgtccctgtcttgtgccagttttcaaagggaatgcttccagtttttgcccattcagtatgatactggctgtgggtttgtcataaatagctcttattattttgagatacgttccatcaatacctaatttattgagagtttttagcatgaagggctgttgaattttgtcaaaggccttttctgcatctattgagataatcatgtggttttttgtctttggttctctttatgtgatggattatgtttattgatttgcgtatgttgaaccagccttgcatcacagggatgaagccaacttgatcttggtggataagctttttgatgtgctgctggattcggtttgccaatattttattgaggatttttgcattgatgttcatcaggggtgttggtctaaaattctctttttttgttgtgtctctgccaggctttggtatcgggatggtgctggcctcctaaaatgagttagggaggattccctctttttctatgaattggaatagtttcagaaggaatggtaccagctcgtctttttacctctggtagaattcggctgtgaatctgtctggtcctggacttttttcggttggtaggctattaattattgcctcaatttcagagcctgttactggtctattcagggattcaacttcttcctggtttagtcttgggagggtgtatatgtccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttccttattagtcttgctagcagtctatcaattttgttttttaaaaaaaccagctcctggattcattgattttttttttgaagggttttttgtgtcctatctccttcaattctgctctgatcttagttatttcttgccttctgctagcttttgaatttgtttgctcttgcatctctagttgttttaattgtgatattagggtgttgattttagatctttcctgctttctcttgtgggcatttagtgctataaatttccctgtatacactgctttaaatgtgtcccagagattctggtacgttgtgtctttgttctcattggtttcaaagaacatctttatttctgccttcattttgttatttacccagtagtcattcaggagcaggttgatcagtttccatgtagttgtgcagttttgagtgagtttcttaatcctgagttctaatttgattttactgtggtctgagagacagtttgttgtgatttttattcttttacatttgctgaggagtgagtgctttacttccaactatgtggtcaattttggaataagtgtgatgtggtgctgataagaatgtatattctgttgatttgggatggagagttctgtagatgtctattaggtctgcttggtgcagagctgagttcaaatcctggatatccttgttaaccttctgtctcgttgatctgtctcatattgacagtggggtgttaaaatctcccgatattaactgtgtgggagtctaagtctctttgtaggtcactcaggacttgctttatgaatctaggtgctcctgtattgggtgtatatatatttaggatagttagctcttcttgttgaattgatccctttaccattatgtaatgcccttctttgtctcttttgatctttgttggtttacagtttgttttattagagactaggattgcaacccctgctttttcttgctttccatttgcttggtagatcttcctccatccctttattttgagcctgtgtgtgtgtctgcatgtgagatacatctcctgaatacagcacactgatgggtcttgactctttatccaatttgccagtctttgtcttttaattggggcatttaccccatttacatttaaggttaatattgttatgtgtgaatttgatcctgtcattgtgatgttagctggttattttgcccattagttgatgtagtttcttcctagcatcaatggtctttacaatttggcatgtttttgcagtggctgataccagttgttcctttccatgtttagtgcttccttcaggagctcttgtaaggcaggcctggtagtgacaaaatctctcagcatttgcttgtctgtaaaggtttttatttctccttcccttatgaagcttagtttggctggatatgaaattctgggttgaaaattcttttctttaagaatgtagactattggcccccactctcttctggcttgtagagtttcagcggagagatctgctgttagtctgatgggcttccctttgtgggtaacccgacctttctctctggctgccctttacattttttcctgcatttccaccttggtgaatctaacaattatgtgtcttggggttgctcttctctaggagtatctttgtggtggtctctgtattccctgaatttgaatgttggcgtgccttgctatgttggggaagttctcctggataatatcctgaagagtgttttccagcttggttccattctccccgtcactgtcaagtacaccaatcaaacgtagatttggtcttttcacatagtcccatatttcttggaggctttgttcatttctttttactgttttttctctaaacttctcttcttgcttcatttcattcatttgatctgcaattactgataccctttcttccacttgatcgaatcggctgctgaagcttgtgcatgcgtcatgtagttctcgagccatgattttcagctccatcaggtcatttatggtcttctgtacactgtttattctagttagccatttgtctaatcttttttcaagatttttagcttccttgcgatgggtttgaacatcctcctttagctcggagaagtttgttactactgaccttctgaagcctacttctgtcaactcgtcaaagtcattcttcatccagctttgttccattgctggtgaggagctgtgatcctttggaggagaagaggcactctgggttttagaattttcagcttttctgctctgttttctccccatctttgtggttttatctacctttggtctttgattatggtgacctacagatggggttttggtgtggatgtcctttttgttaatgttgatgctattcctttctgtttgttagttttccttctaacagtcaggtccctcagctgtaggtctgttggagtttgctggaggtccactccagacactgtctggatatcaccagtggaggctgcagaacagcaaatattgcagaacagcaaatattgctgccggagccttcctctggaagcttcgtcttgggggcacccggctgtatgaggtgtcagtcggcccctactgggaggtgtctcccagttaggctacaagggggtcagggacccacttgaggaggcagtctgtccgttctcagagctcaaacactgtgctggtagaactactgctctcttcagagctgtcagagagggatgtttaagtctgaggaagtttctgctgccttttgttcagctatgccctgcctccagaggtggagtctacagaggcaggcaggcctccttgagctgtggtgggctccacccagttggagcttcccaaccactttacctactcaagcctcagcaatgatggacgcccctcccccagccaggctgctgccttgaagttcaatttggaactgctacgctagcagtgagcaaggctctgtgggcgtaggacctgctgagccaggcacgggatataatctcctgttgtgccatttgctaagaccgttggaaaagcgcagtatttgggtggcagtgtcccaattttcccggtatagtgtgtcacagcttcccttggcttggaaagggacatcccccgaccccttgtgcttcctgggtgaggcaatgccccgccctgcttcagctcaccctccgtgggctgcacccactttccaaccagtcccagtgagaagaaccaggtacctcagttggaaatgcagaaatcacctgtcttccgcgtggatcatgctgggagctgcagacaggagctgttcctatttgaccatcttggaatgccacctttttttttttttttttttttttaaggcagtttcttgctctgtcacccaggctggggtgcagaggcatgatcacggctcactgcaacctctgccttctgggctcaagtgatcctcccacctcagcctcccaagttgctgggaccacagccacgcatcaccaggcctggctaatttttgtgttttttgtagagatagggtttcgctgtgtttcccaggctggtctcaaactcctgcgctcaagcgatccgcctgcctcagcctcccaaagtgctgggattacaggcatgagccactgcacccggccaatatgtatgttaatctcatccctcaagctgatactgaagtttttcaatttatgttatttggtgtaaatctaggcagtctttaacaaaattggtgcttcatgtgtttaagaggcataacttaagaattgtttgtttcttataaatcaggagaatggaggtttaatagaggtgaactgtctttctcactgcagaacctttaatatgccactatgcattgtaaatctcccaagagtgagattctagtatgatgcttttcttttccttttctgttctttccctttccctctacctcctttttcttttctttgttggtggcatgagtcctatattataaggaaatgcttttagagtacagtcttctgatatatagtgatttttgaaaaagatttatttattgtcttgttcactgtgagctttttcccccatgtataagcagctgtgtaatagattcaagagcaccccctcgcccctttttttttgagacagagtctcgctcggtcactcaggctggagtacggtggtgctgtgatcatggttcacctcgacttctgggctccagcgatcctcccacctcatcctctcaagtagctgggaccacaggcgtgtgtcaccgtacatggctaatttttctatttttagtagaggcagagtttcgccatgttttccaggctggtctcgaactcctgaactcaagcagtccacctgtctcagcctcccaaagtgctgggattacaggcgtgagcctccactcccagtctcaaatattcttttgaaatatttgaaatatgttgatctctcagtctttcaaccttagttgtatgttgattttcaataaaaaggaagtatttgttgccctaacatcagtattggctattcagtttaaaaaaggagttaaagagatgttatttataggcaggcttcaaaagaggaaagaatgatcagtttcattctctgtttctagcatattctgactccttctctcatattacctcgtttttcccacattttttctttaataaagtgaaattcacataacagctaaccattttaaccacggaaagtgtacattccgtggcatttattaccttcacagtgttacctctacctttatcaagtttcaaaacattttatcaccccaaaagaaagccctgttcttattgggtgcctcttgcttttttttttttttttttttttaaatcttgagacggggtcttggtttgtttcccaggttgtagtgcaatggggcgatctcatctcattgcaacctctgcctcccgagttcaagcaattctcctgcctcagcctcccgtagctgggactacaggcacgcgccacatgcctggctaatttttgtatttttagtagaaacgtggtttcaccatgttggccaggctagccttgaactcctgaccttaggtaatctgcctgccttggcctcccaaagtgctgggattataggcgtgagccaccgttctggccacctcctacttctttcattagtcttaattccttagtggatttgacagtgtttatattatctacaccaatgcatttttttgtatgttaataataggagatatttattgggcatttatttacatacttatttgcatgtgtaactgttgtatagccagtttatgtatataatcttactaaatctctacagtaaatctatccccatttcatagatggtttaaaagaagttaacttccccaagcattacttttagtaagtagtgagactgaaggttgagttctggtctgtcagattccgaagttgtttccttaggaaccatattatcttgtgtacaactcttgggctaatcttgttaatattctttatttgacctcacactgttgattcataccatgtttaaaattgaaatacattacctatatttaaaaattgagacctcacataaaaagctatatttctagctgcttttgaaatttcgaaggatcttccaacacttggctgacattcctgcgtgacaaaaatcagctggagctgtgtaatgtccgacctgtctctgtcaatgaacagattattcattgtcatttctcatctgtttttgagattgtaactttgattctgtataactcatagaattagtagttagacctatatatgttagttattacattatttgtatatgtacagactgctttagacaatattgtagtgttatatgttaattttatcaattaaaatgtgctataggatcattgtagagatcttgtctctaattaacaggattcataaagagaaaacaaaggagagaaacatccagattgaaaagacctacatagtgccaagcacaataaaagaaaccctatactaggcaaattattatgaaatttgttttaggacaccagaaataaagataatatctaaaaactttttagaatcgcctaggagggattaggaatatgaatagcatctaacttgttggcagtagaattgaaggtagaaggtggtaaaacatcaccttgaaagttctgcattcagcctagaattctgtatccagttaaaccatcaatcaagtgtgaaagtagggggaaaaactcaaggactaaaaaaatgtgctcatgaagaacattttttttggacattacccagaagatgtggttcaacaaaacaagggaataaaccaagaaaggaaataaaagagcttcagtaaacagagaatcccactcagaagcaacaaagaagaaagtcccaggatgacagctgtgacacaagctgaaaagttaccagttttgcttggagcaggagattagaacttccgggaaaataatcaaattgatagatggatgttgaaatatttggagaaaaatgtaatggattcttgcaaaactgagcaaattagaaaaaggaaacaattattagcattggtggtttgagttaacccaaaattgtgatgttgctattttaggggaattaagataagtgaaacacgtatggaatactgctagttttgtaagtctcctttaccatggcaggacatctgtagttaataaatctgtaagaagcagtattaagaataatattttaaaatacctaattaaataggaggaaaaagaatccgagtagttgagggtgattgcatctggggagaagcaggaataaaggtttgaagataaatagggccagagatgagtaattttgttactgtgataatatattttatatatatgtgtatgtgtgtgcgtgtgtatatatatatatgagatatatctcatatatatgagatatatatgatatatatatgatatatatgatatatatatataaaacatacagttcagtagcattaacatctagcattcagtacatttacattgttgtgcaattgtcaccactgtccatctctagaactttttcattatcccacactgacataccacacccattaaataataactcctcattgctcctcctgttagtaccaaccattgttctactttcatctctatgtatttgactattctaggtacctcgtataagcggaatcacgtgatatctttttgtaactggcttatttcactaactatcttcgaggttcatccatgttgtagcagttgttagcatttccttccttttaaaaggccgaataatattccattgttatgtatataccatattttgtttatccatttattcatcaatagacacttttggctgttgtgaataatgctgctatgaatatgggtatgtaatacctgtttgagtatctgctttcatttcttttggatatgtacccaaaagtgagattgctggattgaatggtaattctatatttaaatttttgagaaaccaccatactgtttgatatactggctgcccaattttacattaccaccagcaatacactagggttccgaatttgccacatcctcaccatcgtgttgttttgtttatgtttttttttaataatagccatcctaatgggtgtgaagtctcattgtggttttaatttgcattttcctaatgatcagcgatattgaacatttgcacatgcttatttggtcatttgtatatcagctttggagcaatgatgtctcttgaagccttttgcccatttatgaattgagtagtttgggatttttaaattgtgttttagaagttctttgtatactctggctgggcacggtggctcgtgcctttgggaggccgaggcaggtggatcacgaggttaggagttcaagaccagactggctggtatagtgaaaccccatctctactaaaaatacaaaaattagctggtgtggtcgggcgtgatggtgcacacctgtagtcccagctgttggggaggctgaggcaggagacttgcttgaacccggaaggtgggggggttgcagtgagctgagattgtgccactgcactcagcctgggtgacagagcgagactctgtctcaaaaaaaaagaaaaagaagttctttgtattctctgaatattaatcccttattggatatgttatttgcaaatattttctcccataaagaatgggttactttttcactctgttgattgtttcctttgctgtgcaggagctatttagcttgaaaaaatccaacttgtctgttttcttttgttgcctgtacctttggtgtcacattcaagaaataattgccaaattcataccatgaaactttcccccatgttttctcctgaaggtttttatagttttagctctcacatttaggtgtttgatccattttgagttaaattttgtatataatgttatgtaagagtccagcttcacacttttggatgtgaatatctagttttcccagcattatttgttgaaaagagtgtctttttccccattgaatagtcttggcactcttgttgaaaattatttgacaatagatgcaagggtttatttttgggctctctcgactattctgttagactatatgtttgtttttttatgtcaggaccaccctaattttagtactgtagctttatagtaaaatttgaaaccaggaagtatatgtcttgtgtatttatttacttattttttgaaatagcatctggctctgttgcccaggctggagtgcagtggcacaatcttagctcactgcaacctccacatctgaggttcaagcaatcctcccacctcagcctcctgagtagctgggattgtagacacataccaccatgctcagctagtttttgtatttcttgtagagacagggttttgccatattgcccaggtgggtctcgaactcctgagcccaagcagtctgccctcctcagtgtcccaaagtgttgcgattacaggtatgagccaccgtgcatggccccaacttcttatatttcaagatggttttggcccttcagggccctttgtgagttttaggatggattttttttttaacttttaagtttaggggtgcatgtgcaggtttattacataggtaaatttgtgtcaaggtgttctgttgtatagattatttcatcacccaggtattaagcctagtacccattagttatttttcctgagctcgcctcctcccacctggatttttttttttatttctaccagaaacattgttgggattttggtagggattgtattagtctgtagattgcattgaatagtactgacatcttaacaatattaagtctttaaagccatgaacaccagatgtctttccatttatttacgtattctttcttttctttcagcaatgttttgtaattttcagtgtacaagtattttacctccttggttaagttaattcctaagtattttattcattctgatgatcttataaatctgttttcttaatttcctttcctaattgttcattcttagggtatagaaacacaactgattcttcgcacattaaatttgtgccctgcttcttcgcgggtttgtttattctttttttgtgtttgaaatccttgaggttttctgcatataagattatatcatctgcaaatgagataattttacttgttcctttccaatttgagatgatttttattcattttcttaatgctctctcatacattcaatactatgttgaatggaagtggtgaaagcaggcatcctgtcttgtttctgaccttataggaaaagctttcaattctttgccattgactatcatgttagctatgggattttttttttccccccagatagagtctcgctgtgtcgcccaggctggagtgcagtggtgcgatctcggttcactgcaccctcctcctcccgccaggttcaagtgattctcctgcttcagcctcccaagtagctgggattacaggtgtccaccactatgcccagctaattttcgtatttttagtagaaacatggtttcaccatgttggccaagctggtctcgaactcttggcctcaagtgattcacctgcctcggcctcccatagtgctgggattatagtcagccaccatgcctggccactgtgggatttttatatatggccttcattatgttgtggtaatttctttttattcttagtttattgagtgtttttatcataaaatcttgttgaattttttcaaatattttttctgtgctagttgagatgaccatgtgatttgttttcttctttctattaacatgatatattgtttttcatatattgagccatttttgcatcccaggaataaattttacttggtcttcgtgtataatccatttaataagctgtggaattcagtttgttggttctgtgttgaggactttatatcaatgttcctaagggctactggtctatagttttcttttgtagtttctttgactttgctatcagggcaatgctggcctcattgaatgtgttaggaagtgtttcctcatccatttttggcaaaactttgggaaaaaacgatgttctttaaatgtttgatagaattcacagataaaaaaatcacatctagggcttttgtctggaatttttttattgttattattgattcagtcttgttactagttataggtctattcagattttctttttgtgtgtgtgattcagtattagtacattttgtacttctcgttatttctccatttaatctatattatctaatttgttggcatacaattgttcatagtactgtcttctcttttttttaaacttctgtgcagttgatactaatgtccctacttttatttcagattttagtaatttgaatcttctttatcttaatacaggtaaagctgggtcaattgttaaaattttttcaaagaaccagtttttggtttcattgatttttctctgttatttttctattatttatatcctctctaagctttgttatttccttcatcctgctagctttgggtttattagtttgttctttttctagttccttaagatttgaagttggattattgatttgagatcgttttcaattaaatgtgtacaactacaaatttccctcttaggactgcttttgctgttctgtaatttttggcatgttgtgtttttttgttttaatttatttctaagtattttctaagttcccttgtgatttcttctgcgtttaaccgtgtattttttaatttccacagttggtgaattttctactttttcttcagttattgattttattgattttcagtggcatcctgttgtgatagaagatactttatttggttccctgttttttttttaaaacagagtgttgctctgtcacccaggctggagtgcagtggtgcgatcttggctcactgcaacatccacctcctgggttcgagcaattctcctggtctcagcctccccagtaggtaggattacaggcacatgccaccatgcccagctaatttttgtatttttagtagagacagggtttcgccatgttggccaggatgatctcgaactcctgacttcaagtgatccacccgccttggcctcccgaagtgctaggattataggcgttagccaccttgtctggcccagatcctctattttcttgcctatattctgactgggtgtttttgtccattattgagagtagggtatcgaagtgtccagctgttatttcagaactgtctgtttaccttcaattctgtcaattttttgcttcatataattgggtggtctcttattaggcatgtaaatgtttttgattattatatcttcttgctatattgacacttattgatgtgtaatatcttttttgtctcaaccttgttttgatttagtttgtctaatattaatgtagctacctgcactctcatttggttattacttgtatagaatgtctttttacatcccttatttgtgtctttggatctgaaatgagtctcttgtagacagcatatacaatctcttgtagattgtgtttttcttatacattctgtcaaactctgccttttgattgaagagttttatcatttacaattaaagtaattattgataaggatttaactgctgccattttgctgtttattttctatatgccttacagcttttttgtccctcatttcctgccttactggcacttgtgtttagttgatattttgtggtgaagtgttttaatttccttgttatttccttttgtttatattctgctattttctgtgtgtgtgtgtgtgtggttgccattgggggtcacatttaatgccctaaagttataacactgcaatttcaatttataccaatttactttcaatagcatacaaaaattcagctcataagattcagtccctgctcccttccagttattgatgtcataaaattacatttttatgtattgtgtgtctaaaagcgtagactaataattgttttttaatgcagtagtgtcttaatttgtggaaaacaaaaagtggagttgtaaaccaatgttacaataatgctagctttggtaattgctcatgtatttatcatttctcagatctttatttcttaatacagcttcaagttactgtctagtctccttttatttcagcctgaaagactcacttcagcgtttcttgcaggacaggtctggtgataatgaactctctcagattttgttaatctggaaatgtcttaatgtcttcatttttaaggacatttttgctggatatagtattctcagttgacaggtatttgtgtttatttgtttgtttcctttcaggattttaaatatatcatcccactgccttctgtccttcaagagttctgatgagaaatctgctgatattgaggatccctttgtatgttacaagttgcttctctcattccatgttcaggattctcttttttcatagtttgattataatctatctcagtttttcctacttggatctctgagtttttcctacttggagttaattgagcttcttgaatatttatattcatgtctcatcaaatttgggaagtttttgattaatatttcttcacataatcttttttgccccttttctctctttttattctgggattcccagagtgtgtatgtgttggtccacttgatgatggtgttccacaggtgtcttaggctcttgtcttcaattttccttcagttttttttttctgttcctcagacacgtggtattttcagctgttctgccttccaagtttactgattcttctgcctgcccaaattggcttttgaattcctctagtaaatttttatttcagtttttgtacttttcagctccagcatttattttttgatttttttatgttttctctttattgatatttcaattttgttttttgacattatccatatcttcctttagctttttgagcacctttcaacatttgttttaaagtctatgtctagtaagtgtctgccatctgatcttctcaggcacagtttctgttaatttatttttttccttttggcctatacttaatgttttgcttggggtagtttttttttttggtatgctttgtgatttttgttgttgttgtcaaaaactggaatttgaatcttaaagagtggtaactttggaaattagatttttctcttttctctaagatgtgctattttgtttggtttttttatttgttgtagagtatttctatgctgggtgtaatcttaagatcttctcggcctgtgtttttccctgggcatgtgtagtgactttctaaattgccctatgtatgcagttcttttgcagtagtatcctccttaaatgtttggctcctaaaaggcaaaataaataaataaataaataaaaattaaaaattaaaaataaatcaaaggggtgaaatagctctggatctttaaatccctggagcaattttttcagccaatggcagttaaataatgatagtctgcctctgtgtcacattttgatcagaagcagcaattagcaatcagaacacagattcctgatatttggagggcaaggtctttgttgccaaccttgactcttacaaactgtgtgcagggtgctctgggaacatgtgcatggttgcctgctttgagagtgggtgatgggtagccgcgacggcacaaagagctgaaattgactcaaactaactgatttaccattcaagtctttccttagaaactgaaaacctgaatagactccagagttccagaatcacagattctgcttacagtcgtctaggtggggagatgggttcctggtacttctgattctgccatctttctttgactaattttttttttttgttcttgagatggagtcttactctgttgcccgcccaggctggagtacagtagcatgacctcggctcactgcaacctctgcctcccgggttcaggcaattctcctgcctcagcttcccaagtagctggaattacaggcgtgcaccaccatgcctggctaattttttgtatttttagtagagacagggtttcaccatgttggccaggctagtctcgaactcctgacctcaggtgatcaacccgcctcagcctcccaaagtgctaggattacaggtgtgagccactgcacccagctcttagacaaattttttattccaaactttttttattttatcatttgaaaggtatatgtttattattttgtcaaaaataattttaaaacgtattcttgaagcttatttagatctgtttcataggaactgtgaagaaagtaaagaatttaaaaaatgaagacagattttctcaccctgcttatgggtgcttctcgtgctagccttttgcaagtgtcgggaagtgtaacctgcaggaggcatcagggctttgggcctgcatggtctgagtgctgccctgtgagtttcagaaggcgcagcaacctgtatacctgaaagccatctctgctggggcaggtacctagtgtccccacctacctgggtcgtagtcaggccctgggcaagcctgctatgcttttccttccctaatccctcaggggtgggatagagagcacagtggcctcccagggaggtagaagctgctccagactaacaatcagagctgccagttcttaatccccaagaccgccagacttcacaaagacataccgaggtctgtgctgtcagtgccccactactacactcccttaagtagccccacattcttgtgcttgtttcttttttctgctctctttccttgcccaggtaagaggtctgcccataagggatattttgcagcatgtgaagctttttaaaaagttaggcttattgaagtataatttacacacaaagtacaaaaaaaaaaagactgtgttctcaaatctgtgagtcattaatgggtttagatgtttatatattgaaattattggaagtaaggtatgtttatattagaaagatttgtagtctagattatccaagttttgggagtattacctctctgcttttgtttatctacttttttagtctctactttccaagtatctataggcaaattttcccatttccctttggaaagtgctgttttcttgctttttttccgcctttccattgtgtcagacttataaggcaatcagccaactgtgggcatgaaatccttgggaggaaagagaaggaagtgggaggggcagccatggtgaatgtttccctaagttatagtcaagttctttgagagaacataacctcatcccctttttaaactgttgtaatactttcttttaaatagattgtttattctcctgcaagtctcacagttgttcacagtggtaggtaagaaatcataaagttcaaatattaaagggagctcacaaaagagcatggtttcaccagccctcactaaaaacaaaattatgggaaaatgctgtaaaagaaaccagaattcttggttgcaaatgatagaaagtgactctgatttacctaatcagaaaggaatttttaaaaaagtattaggtaggtcatagtttgacaacaagacttggaagataggtggaagctaagggaagcaagacatggccccaaggtttcaacaggagcaatctgcttaggactttgctgcttggacacttggtgtaatagctgctgccactatgcctcgaaactggtgactctgctcattaactcacctcctctggtgatctctaggaataatctctgactctcctgtaccttgtcctcactaggattcggtatccacggcaaaaagatctattaatagttggtatcaggcctgtacatgtgttaagagaaagatgaggaaagaagtatctgcttctaatctcttgaaattatctccaaattgaaatggtattttggttgcctaacagcctgaagatgacaaatatcccctacaaatttctcctattttaccctcttcctaactatatctgtaatttaaagtttcacatattcttttgaaaattgttttcattgtttacccactttttaagaaaagcaaatgggaacatactaccactgtttggcccctttcaaaaattttatatctgaggaatcttccatattgttgtggacatctacctacctgattcttttattaactaccttttatttcattttatgatcatgctatcattaataggcccctatgatgaatatataagttgtttccagttttttttttgtcattgagaacagttcacatatgtatcttgttgtcttttccaagtatatctttaaggcaaattcttagcagtggagttgctaggtccattgcgtctatggtttaaactagtgccttcaaaaatggtattttatatactcactgtttaagagtgcttcttccttctatccccactaactttggcaaactgaatagtttcaaactttaactttttatagcttgttggcaaaaaatggtatcttgttatttgatcgtgtttttttaattgtgaggtttagcgactttttgatgtattggtcttatgtactttctggtgtgtgtgtatgtatatactgaccctattttcaacttatttttcttttagtttgtttgtattttccttaatgattttcaggaaaccaattttattctttcttcagacagttgtctaatgttctgcttctcttgccatttgaattttgtgactacaaaattcagatgaaacaataatagcataaagaacttggtgggttatcttttgttttgcattattgattgtttattaagaaatattctttaaaagtcaccttgcttaaattagcaagtaggaaatgctttcaataaagagaactgtcatgtacccactactccttacttactgaatcatcttcttttggatagagaagataaaagtgaaaagggaatttaagagttcctgcctttttccttgtctttagcattatatagctgtttaatgtgtgggagtctaatttcttttttctttcttgagacaaagtctcactctgttgcccaggctggagtgcagtggcacagtcttggctcactgcaacctctgcctcccaggttcaagcaattctcctgccttagcctcctgagtagctgggactacaggcatgtgccaccatgcccggctaatttttgtatttttagtagatatgggacttcaccatgttggccaggctggtcttgaactcctgacctctagtgatctgcctgctttggcctcccaaagtgctgggattacaggcatgagccactgcacctggcctaatttttttattgttctttttggtgtgaacattctcccctcctccaagccttttgtttttactattttcatgttcctttatatgtgctgctgttttgtttcatctgtaattatctctcatccccttttttggctattataatatatatatgtacgttttgaatctgagctttgaaggtaaattcactgcagctgtgttggttgattttagataatttgtgtatttcctcctttgtcttttttaaactggagtcatttgtagttgtttatacagaattttagtttttaaaaccacaagtctttcattataggttgagttatgaattcatagcctgttatttaaatgaagcttttgaaatctgttttactgatctgtatcatatctaactacgccagtatttccttccttgtctgacgtgaactctaaaattatgtgaacactttctccctgtttcctggcatttccactcaaacttgttcctcattcttagttagaaatatatccagaattgtagtttctttctaatctaatgacagaagcaaattaatcaagcatggcaagaatttattggaaaactgcatgtagttgaaaatatgtttagtatatattttgacagctgtgaagtctctaatttttactgtaccttttctctgttccaattttatgctctattctaaggatgtacccatttctactacctgactagggagcatgtgtattgtatcccagcagattttttttttcatagatagatatcctttagatatctgttatccagtgtaggtagccactagccacatgtagctatcattatgtttaaatgtaaataaaataaaataaatttactgagttgtttttgctagctacatttcttgtgctcagtagctacatgtggcttgtgattactgtattaagacagcacagatacagaacattttcattattgcaaaagttctgttagacagtgctgttctatacagtgtcattctgcctctcattctaaaaagttctaattcctgaagttgatgtactctttctgttgctgtcctctagcttaatcaaaataaatttgagtctttttaaaggtaggttgcattttacatactgatatttctaaatcagaggctatttatattactttttttatattacttttaaaaattagctttattggagtataatttacatgcaataaaatctacccattttaaatgtacggttcattgacttttgagaaatacacacacacacacacacacacacacaccttcttgtaaacacacaccttcttgtaaacacaacaaccaagatttagaacactcgctttatgaaaagtttccctcatgcccatttgtagtcagtccccaaacctggtttcaggcaatctctgatctgctttctatatgctttgcctatactaggattacatataaatacagtcatatagcatgtattcctttttgtgtctggcttctttcttttagtataatatttttgaaatttatccctgttgttactagtatcaataatttgttcttttttattgctgactaatattacattgtatggatatgacatttctttattagtgtggtgggcatttgagttgttttcagtttgggtctgttatgaacaaagctgctgtaagcattcatgtgcaagacttttgtggacatatatttttgtttctgtttattcaatacctttgagtagaattgttgggtcacatgatgtagatcagttgaacagagtagattccagaaaagttcacatacacatttcttgacaaaggtgctgagattattcatgggaaaaggataatcttttaaacaaataatactggaacaatagagaaaacaaagtgaaccttgacttttatgtcttatcatatacaaaaattaatttgaagtggattgttgacctaaatgtaaaagtaaaatttaaaaatataaaacttctagatgaaaacataggagaaaatctctgtgacttttggtttaaagatttcttagacagtacatataaaattaactatataaggaaaaaatggacaaatttgactttatcaacattaaaaatttctgctcattgaaagactcaaaatgaaaaggcaagcagttttggagaaaatatttgcaatacatatatctgaaaaaggacttgaatgtataatatatacataaagatgctcttacaacttcataatgagaaaataaccccataaagagaagggcaggccgggtgcagtggctcatgcctataatgccagcacttttggaggctgaggtgggtgaattgcttgagcccaggagtttgagaccagcctgggcaacatggtgaaacccagtctctacaaaataaaaaaatacaagaaattagctgggcatgatggcatgcacctgtagtcctagctgtttgggaggctgaggtgggaggatagcttgagcctgggaggcggaggctgcagtgagctgtgatcgcaccgctgcacgcttgcctgagcaacacagtgagatcctgtctcaaaacaaacaaacaaaaaaaaaaacaaaaaatggaaacagaaattttacaaaagaagatatatagatggccagtaggcatatgaaaagatgtttaaaatcagtcatcagggaaatgaaaatttaaacgtaatgagatagctcatatttactggaatggctcaaaaagggcttacaggaattggcaaagacatagattaactggaactcttatgcatgttggttagagcacaaaatgatatgatttcttgggagaaatatttggcagtttttaagattatttttgatagccttctgaatttcttagtgagttataggtcagttctgccactgtttctttcttttctttctttctttctttccttccttcccttccttcccttccttgcctgtcttgcctgccttccttgccttgcctgccttgccttcctttcttcctttcttccctttcttttctttcttttctttttttttttaaaggagtctcgttttgttgcccaggctggagtgcagtggcacgatcttggctcactgcaacctccacctcccgggttcaagcaattctccctgcctcagcttccccaatagctgggattacaggcgcgttccaccatacttggctaatttttttaattttggcagaggcagggtttcactgtgttggccaggctagtctcgaacacctgacctcaagtgatctgcccgccttggcctcccagagtactgggattacaggtgtgagccactgcgcctggcctggcactgtttatttcttttccctccagttttatacctatttagagagattagattttcttgagtactaggaatcactatttttgagcagaattattcaaaactgttattattttttctttaacttgaggcaatgtaggagaaagcagtactgtgcaggtgaaagttacaaacaagaacattttaaacaagatagttactttccatgtattggatacgtaacagaattaattctaataaccatcctgaagatggtcaggaggcattagttaagaattgaaatgtttggagcttgcctgtgttgatgggattaaggcagggatgatttatgtgtaaatttatgcgttagtaacagcagtaaccgctgtagttacactagggttctaagagcaaatgttgattaaacatgaatgtagcaggagtgataaggtttggctctgtgtccccacccaaatctcatgtggagttgtgatcctcagtgttggaggaggggcttggtaggaggtgattggatcatgggagtggtttgtaatggttttagcactatcaccctagagctgtctcgcgaaagagttctcctgagatctgcttgtatataagtgtgtagcacctcccctctttgctctctctcttcctcctactcctgccgcggggacgtgcttgctttcccttggccttctgccatgattgtaagtttcctgaggcctctgattaaacctttcttcttctaaaagattacccagtctcaggtagttctttatagcagtgtgagaatggactaatacaaggggaaatatatatggttaccaaatagcgaattagccatgggaaaaagtagcaaataaataattattttactttttcagatgctaatttttcttttcgtttattttaggattggtgggagctgtccaatgtccttaggctgttttccaaatgagataccaaaagctagttctccatcgggtttctcaggctgctagaagcattcattattatggttgtcattacttcgagttctgttgccgctatgcccacagtagtatttgttacataacaggtgcttgataaatatttgctaaatgaatttttggaaaatacaatctgccacacctttcttctacagtttacaatcttctgttgagatcatccgatagattttttttcttagatattgtacttttgaggcctcaaattgctgtcttttgtattttctatgtctgcagagactttccatctttcactcattgtattcattgttttttaacatctttgtacatatttatagtaactgttttaaagtcactgtctgttaattcaaacatctggttcatcttggagtctgattctattgcctgctcttttttctttgtaataggtcatgtttttctgctttgcctgtctagtaaattttaatcgtatgttgaaatgtagggagtttggattgttacttcctttaagggtgctgagtttcattttgtcaggcatttaaattgatagttgatttagtattgtcaggtttggttctctttgttaaagcaggcatttttcagatttgtcttttgtcctagggcatggtttttaacttcaaggttgccctttccaatgtctcagctaagtatctggggtgttccatgaggtctcttccactttgcctaggccagaactccagcttctcccagtattatatttcgttacctctggcgtcatctccgttatgctttcagatcctgcgcatagacagcccagcccccagccaaggacctgagatgaaatccatacaaaattcttagtcccttgctccacaaactccaacagccttagcagtctaatctcttcctgtttacctcagtgaaatctgtgttccacttgagttccatttccttctgtatcagagaagagccaccatgctgaaagcaaggggcactatgtttctttgttcttaaggatggtagcctatctgcaacaactgtagtgtgatataaaaatatataatttatgttgctgacagttacaaatactgcttgcagtactttgtaacataatttttcagattcaagttcatatactctttttttccacatcaccacacacatattttcagacttcctcctcatccttcttcttgccagtagttgtattataattcctgccagtagttacattataattttggttatatcaatattgagtttttatgggattataactagataaatgccattcatagttaagtgatagagtatattgtgacttttttcctgcatgttttattttttctggacttcacagttgtctctcttttttttaaaaaaattagttttcaatgttcttagctttaattcataaactcacccctaattgtataaatctctcaacatgtttaagcacatttggcattatatcaattttatcttttccaggtgccttctaatctgtcccagtctggactaattgttcttcctggcttgctgtatggctgtctactcaagatgtcccttcaccatcattctagggattcccttttcctctcttgtgggttagattcttcagttcttggagactgtcatcttctttcatggtttcccactcttgttttggcggagcacatctttagtaacttcctgacaaagtgtatggtttgagatttcgctgattttaaaatgcccttattatatagtcacacttgatttatagtctgtcttggtatagaattctaggctgagaagagttttccctcaaaatcagaaggttttgcccaattgttttttagctgctagtattgctgttaaaaaggataatgtcattttgattctagattcttttatgaaacctgtttcttctctggcagcttttaggatcttctgtttctttggtattcagaaatttcatgagatatgtgtgcttctattttggtcttattttcatctgttttgccaggtactcatgcaactttccagtttgaaaactcacatccttcacttttgagtatttttcttgagttatgtcttcggtttcttctcagtgttctctgtttctggaactcctaaaatatatttaacatcctgaactcttagtttttgtttagtcttctgattttcatttgtctttttattctgtatattctgttaattcctcggcttcatggtcttctagcccttcttttgcctatcttatggggttgaggattaaacagtttatatacctgaggtgcttaggatatgtctgtcatatagtaagtgcttgtgttagctgtaattgttgtttactttcataactgtcttgagggaaaggtctttggtcttgattctttgacttcttggctgtacatgaccttggacgagttatgtaatctctttgagacctacctccctcttctgtatagtgttaataagctctagctctcagatgtttgtgagggtcgaatggagtatatatgtgaaaatgtttaatacctttgtacagaattaatagttagtacgtggatctttcaaatatcaaaagttttcagtttgatgggaaaatgatgtctgaattttcagggttatttttaagagtacttgattatgactgtcttgtaaatctctatgagctaggtatacttgcactaaatgctaatgctttttaaagaagttatgtcttaatattcagtctcattatgttaggttgaagatagaagattatgaaaatattctctgaaaagctctggttttacttcagattgtataaatctgtgtaatgtaataattatttaagaatgacatgattactactctaaacccatagaaggggtatttgttggattatttattttcacttaaatggtatttgagattaggaaaaagaaaatctgtcttttggtttttcttgatagtattaatgtaatttcaaatgttagctcatttttgttaatggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttgttagagtgaggtagagttaaagatacattttaacagaattgtattcctaaaccgattaagtcaagaagtccaagagcattgttagatcatttagaaagtgtagtgatgaggtaaaacattgttggcacagattcatgttacttgatctgctttaaatgacttggcatctagcccatatttgagcccataaccgtgtggtaatttgaagtgtaattcacagtagagcttctgttaaagcactaatagcatcttccatggaggtatacttcagagtgaatataattttgtttatcctgtgtctctagagctattgactgaaaaagctgttagggcattctctaactgtacatcacctaagttatttaaaattgctgaattaggtggcttgtcttgtctaggacagagttttaaggactgcccacctgattgatagagctagttgaccttatctttaactttttgtttttcttttgactttgggagtagagatgtgaaaaggtaaaaaggaaggaaggaagagaaaacttaactctttttgcccatgaagactgtttttccttctcaaaatattgactattttctgatttgtaaaaatcggcacataaaacgtgttattttttacttgacttttatctttcccatgtgatatctataaattatagataggaaaaatttatctgtaatttagtgatctttctagtgtgataaaacgtcagaagtactgagagtggagtggacattgatattgttactctcagtaagttttcactgatttttctcagagtcatgaaggaacaaacgtttgttaagtccttatcacttattagataacacaaaacatgttgggggggtgtgtacagaggtgagtaagatgtagctcccattctcaagtcgcttacattctaatgtaaaaggtagacaaagcattacagaagaagtaactctgctatagaaggttgcaatgaagagaacattggaaacactaattttaccttataaagaaggtttcataaaggaaggcaagtttgagctggggtgaaaaggaccagtaagggttgactttcaagccaaggagaggaggggaagtgatgttacaggccaaaggaatggcattgtaagaagcttgttggcataaaagtgtttagaatatggcagcgaattcattatcatcagattgtggtgtctgtatgttgggggtgggagagaattgtggtggcaataggcaacaagataaaagaaagtaaaaggtgttatggaaacttaatgggtccagcttacaaatgatctatgcatttaggggtctttctcttttcctgataaacctctcctacaaagagccttgttgcggataccatagtgtttctttggaggaaaataaaaactacaaagctttgtattttttgcacaactggattcagaatataagtaataaaaaaggacaagaactttcaaaagctagaagccattaaactgagtcacttcagggttagactatcagaactggggatttagaaagtctcagaatggaaatcgaaggacaccaaagacaaattcggcctttttcaaaattttattctagtttaacatattcaaagaaagggaaggaaattcttttcattcctgtgtgtagtgacttcctgctttaagaacttaggacttcagctgtactatcagtattgtaggccacttaacattattatggttaaagttggcattggagagagcctaggaacctaactgcctgtttgtttttatatttccaaccattggattcccaagttaatgaagtctgtttattagttgagggtagctcttaatgcatatattttaatgccccttccccacatggaatcataagctttcagaactggagagtacctgaaagagatcatttagtccaaccttctcattttacagatggggaatctgaggcctagagaagttaagtgagttgaacaaggtcacacaggtacatatggtagccgaccatccactgtttatgccaatattccctttacgttttgcttttttgcttgttcgttttaacctctccaaattttactgacttcagaagtttctagaactaagttatagcatgttttgagttctaatgtcactttccgatcttctttaccttttttctacctctgtttgtatttctggttctggttaagtgagtctggtaagcagcaggtgttctattttatttcttttatttttaggatagtattacatgtgatatatatgtctttgcaaacatacataatttgaagatcttaaaatatttgcactaggcatacccacatttaatagtatgttaaatcttttatagcaattatgatatacatgggtgaagaagagttcctaatatggcctttctgattaactgtatctgtttatatctgtgttttcttcaggcattcataacattaagcaaattcaggtgtactgttacttaattgaattaatcagtttgttttgtacaagtatattttatttttgttccttgttgtataatctggtaggaatggggaaggggagatagtgaataaagagatgtatacttcttgcctttgaggaatttaagttttcactgtataccaattttttaaaggtatttactatatttcagtgcatattttatttgacatactttatcattttgtggtaaacctttagctttactaattttcatctattaagttttcttttgtaagatggtgatagcttcatcaaagagagtaaagaagagacctgcctacctagctgattctatggcaaatctcacttctctggaagcttttcctgttaatcttattccttcagtttctgcctcttgtttcataaaaactcattctttaaatgcttattcatttctcttgtctcatataaaccaatatgaggtactggtatcttttgagttttagttataaggaagcataaatggttaaatttaaatggctaaaccccatttgccatttgtgtatctttaattttagtttgttgagagacttatcactaccaaaccacaaagaatttaaaagaaactgtcagtaggtataggtggaaggagggcatttatcagagattttaatttaagaagaaagtcttcatccttatcctaccaacccccattccctgagcatatttatcattactagtcccagcatatttgctcccatatttcctatgcttacctgtgaagattttcataactttttccttgctttttactgtcactgttggttctgtgatttatgacagatactgctcttgtaggaatgctggctttgactgaaatttgttactgcttttgtatttaaaactttttttttattataagtagaattatggaacagtagtagaaaaagtttgacttttgtaatcagagatactgagcttgagttctggctctttcatttgtatactgttatttggggcaagttttttaatgctcttaagtcttagctttctcatatataaaatggagataataacagttatcacgtgattgtgaggatgaaacaaaaaaaagtggaaactctttgtaaggtgtgttcatctggttgacacttagtagtcattacttccactttccgtccatatagtcctcttaacagtaatatttgagaggcatttttattaaagcagtcttaaggagtgttcgtcaaaccacatgttctgggatcctgagaaagtaggggaagtttagagaactgaagctgcacaaaactaatgtttattttctgttgtgttgtcctgagaccagcttcttagattgtgtttcctagtcctacatctctgattccttataaaatattccattatgaattcttcactattgacaatttctccccttttatcttaaaagtaccaaagaaagtgtaaaatgtgactgtcttgtcagtcctctttttcctgtttttcatgtcagtgggtatgaaattactagcaaggatgcatatatgtgcatatgtcattactaaatgcattttctttctagaaaaactcaatatactaaattgtactaaaaaggaaaagcttgttttgttttgagtggtagtatgaaagttgttttattttaggtctgaccagttagaaaccaatggattgtagtttatttataattagttaaaccttcatgtgaatttggttttgaattacctttaaggtagagaagaaactatatagatgtttttcagggtttctaaatgtacaatacaggttcacaatcacttatttgaaactcttggggccaagtatgtttccattttcagaaattttagttttcaaaaggtagcacagataaatatacttttacataaacaccccagtggggtgtgggtcagtacctgaaatgaaatgttttactcttcgctctaagtgtattaaatattatgtacaatcttattacttcagatcaggatttgctgtagttgagtttgccataaaacttaagagaaaattttagatgttttgaacttttgggatattgaaattgcaggttaaggagctatggacctttatttgttttaaaatgctaagagtttattttaagtaatttttaaaaaatttgttttgcatagtagttggagttaccagggtactgctaaccacactgatatgtaagatctctttctgagccttttattgtttgtaaacatggcctgttaatcattagaaagccagtacatactaacatatcactgctattaagacaaatattagcatactctagtaatgacaagtcagcattttactattctgtattgattttacttattctttcattactctcatactgtaattaaaacttgcaatctgagagactgttgaaaaaggtgatcgttggcttttcaacagggagtaaggtctggtttaaaaaaaaattagtaagcatttggccaagtagattaacaacattcagtttttctttactgtccttatgcttttactatttttaacatatatctttttgaagaatagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaactcagttctcatggcttaacactttaaaccatgagaaaactgaagagttgagaagcttggcagatgctgctgtgatagtcaaaaagaaagtgggtgccatgagctactattgatgtatttgccattgatccctcctgaaaatctagaatggactttcagacaaatggtttgaaaattctaaatcactaatgattgagatttagtataggtttactaagaacgggttttttttgtttttgtttttggtggatttaggctgttgcttactaagcaaagcaggctttagttgaggtttatcttgctttaaacagatatttaacagattttcctggaggtttttgtgtaccactgggaaaatgaagttaggcagatgactaagtgaaagctgtcctgctgactccttataatgatagtcattgtctaccagaagatctctcctgtcacaccaaaggataattgattatatcctgtaccatattatgagtcacctgattggagatataagacatacttctcacatatttagatgacacaggttagtacattgaatatcagccagggtttttaaggatcttaatagagtggaactaaggtagaaactattaagagcaattaatagtgatatatctatagtcctgtttctaaacaagtttttttaaaaacctcaactctgactatagtgaacagagaagtcttggactcttacaattcatgtgagaagacctgaaactttgataacaattatatacattttgtgagtaatttctttggtgtatgccttcacatatctctggtatgtgacctatgctgcagtccattgagcatagattcccagaatgtattctcctgcagaaaatggaggaaaataatacttggcttccctaatgattacatgtgtatacaacactaacatttgcaagaccacctttaaataacacacttagcatttttattttatgaaatgtaatatgtagttctttgcatagtttatcctattagtaatctattctgtctttggaatatgttttgtgatgatgaaataaatactataaatagtattattccttttgcattgagagtcctgacgaaatgtccatgtgacagttcattttgggtttagctctacctctaatatgtgacctatgctaccagtccgtatagcgtaaattcccagaatatatcctcctgaataaaatgggggaaaataatacctggcttccttaatgattatatttaagacttatcaagagactattttctatttaacaattagaaagttaagcaatacattatttttctctggaatccagtgtttcttttaaatacctgttaagtttgtatgcaacatttctaaagttacctacttgttaattaaaaattcaagagtttttttttcttattctgaggttatctttttaccacagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaaggtaagttattttttgatgtttttcctttcctcttcctggatctgagaatttattggaaaacagattttgggtttctttttttccttcagttttattgaggtgtaattgacaagtaaaaattatatataaatacaatgtataatatgatgttttgatgtatgtgtatatacattgtgaaatgattactacagtcaaactacttaacatattcatcacctcacataattattattctccccccagggtgaaagcatttaagatctacaagctacaattttcaattatacaatgttattattaactatagtcactatgctgtccagtagagcttcagatcttgttcatcttgtgttcctccctccccaccctcagtccctggaaaacaggttttaaagatagttgctaatccttatttcttctaaatttttaaatcagttgctgcctcaatttctatatgagaaatgactgattgatttcatttttctgttcacgctaccattttcatatcatactagcacatgttacccattaactgtattgcagatttggtctcacaaaattcttctaaaataacatttttaaaaagcatattaatcaaaaataagctttatatttctgaagcttgtttgagcatagaatgcctttggataaaataccattacctagtaaagtgtgaacttttataatccataaaaattattcttttataagaatattcataaatgtagttagattaatagaagattctcgattctttgatcagaaaactaaggactatattgaaaaatcagtgacaaatttaattcttatagtacatctgaaagaaaaaagaaaactcttgggagaacttttacagtgatttaattttgctgttgatatatttctttgggtggtaagtatggcaaaacatgttaaaatttaatgcaaagagattttgtacatttttccatctctaagaaggacaaagcctaagcccctccagatagatagaaaaactcatttagagagttctccttcatgttaatctaatttcttcttaattcagctgtaaaacagaaatagaatgatcgtattaatcatttaaagctgtgtaattgcatagattccttgttcctttaccccctcttatatcttgtttcctatcctttgtgactttttttgcattatatataaggatgccgaaatactgtttattgttgatagtttacaaaattgaatcttacattagtgcataattttggtgaatgttgaagattatggtagattgccttacatttctgcatattgtttgcaccttggaatgatagcactggcatgaattatagagctgaggatctaaagatttttactttgatttatcccattatcatctgcagggaaacaattgcttttactgattaaaaatgcaggctgggcacagcggctcacgcctgtaatcccagtactttgggaggccgaggcgggcggatcacaaggtcaagagatcgagaccatcctggccaaccaacatggtgaaacctcatctctactaaaaatacaaaaattagctgggtgtggtggcgcgtgcctgtaatcccagctactcaggatgctgaggcaggagaatcgcttgaacccgggaggtggaggttgcagtgagccgagactgtgccactgcactccagcctggtgatagagggagactccatctcaaaaaaaaaaaaaaatgcagtagcaaaagcgatggtagaaatttaaaacagagttgatgagcagcatatattttggtagtggaaaaaaaggtaaaaaattttttgtaataaaatagaaaaattttgtaatgtggaggcgcagaacactagatttaagccagggggtcttaaattgtgttacattccttttaaagtctgatggaaggtataaatgttctcccctcaaaaaatgtgcatagtgtacataaaattttgcagtttttattacattgaaatatattcttttagacagaatgtaaaagaaccttcatgaaaactatgtcacttttttatgcaaaaaccagtggctactacatgagagcaatgaataaatctaagtggtacaaattaaccaaaattaagctttagttctgttcaatactaaattttaatgaaaagactgctatttaacttttaaaataacaagttgaaactatgctctttgactttgactttgcaacttttatatgatctttgatatccaatcagtgttgactttggtaaaaagtgctgaaaatgctattttacaaaagaaagaagagtaaatggaatctgtagattctattgcctgatgaaagtagacgtgtcaagaaataagaattctccaaggctcttcagataaattcatgtttcatcattttctttgccttcaagttactgagatcatttttggcaagatctgtatcattaatgctgtgttaggaaagaaaagattatgactccacattttactttcaaggttgaagagttaaactgtttaaaaagagtgtatgttatcctgtaaacagcagtatcaggctgtagaatttgtcttctgaaagcagggaacttatatatagcaaagaacttcatagtgctcccatttcttgacaaaacctctcgagaagctcttgattgaaagtcttggctttcatgaatctggcagctttcacaatagtggatttttcatgacaaatcatcttacacagggaattattcaagggttggcacttgaaacagtagaatactttcacaacaagagataagatttctttcaggattgatgacagtcttgcaccctagcgcatactgatgaagagagcagtgggtgaccatgacatggagagcttctgtctttaccagtgccccaatatcagatgtgttgtctggcagtaaggtgtactgtctgcctacagaatactgaggtttcttcaggagaagttttttggtaaagaaactttaccattttgaaagtgttaatgttttctgaagcttccaaaaagattccaaaatgggaatgtttccttgattgtgtcaccatgcttgcatttgatgaaaacttgtagccggctatactgagaaatcatatctgaagaaaggtggtacttccaatctttttgtgacctactttattattgtttttttaatgtcagggttttttttggaatggagaaaagtatttgatagaggtattgcaacagtcttattcttcttcatgctacaagtatatttgactctttctaagatacttgccttcactgttcaactgtgtgactttttgtttgtttagcattacaatcaatatcctagtaggatgatttaatcaatgatttttaattggaacaaatagtttttgtaatggtctaggcttttccaacttaactgtgctctcacatgtggtctctttttctccctctttcctccttcttatacactctcacccacacacatatgcatacataccctgtctgatgtatctgcttcttcagaatagttggctgtgctctgctgatgatgagaacttgccatttaagaaggacttgggatagtccatgtcatcatgttcagggataaaagtaaaacccaagggcatttaaactttattgtattttattttctgtttccagtccaaattaaatccaagagaaggctccataatcaaaaagtaaggacatattttaaatttgccaatgggaagatattctagtcattacagtctggtaatactatcaattctgtttctcttcagaggtgaggggagactatttgatgaaatcgtaagtcctgtagggtgttgtgaaatagggccagaatgaaagatagcaagaatagtgttatgaaaataaaatgcaaagtttataatatcatgtggtaaaatgtaatagtatttacttcatcagtagaactgctctagtagctgtatattctccatccttgcataggttggaatatcccccaagtgaaaagagattgatgggctaatagttaatagaaaatggagatctgtacatacagtgttaagaatgtagatattaaaattgttatatttagctgttacataatattaagactcagagttaagtaatttcactgaaattgattgctttttgtgtcttggagtcaaaataaataactgaaatctactatacttggctcatgcttaattaatatacttagaccatatttcggatgaattattcacagaatctaaaggagtatcctcgtgttcttaccttctttatccctgtgtttatttaaaaaggcaaaaaaaatggagcagatgctgttggttgaccatattttactgaacagtagcatttgtgtttaggttgaaacagcattagaaaactagatacggattaaagtcagtggtaggtttttttttttttttcttccaggaatgtttcttatagatgatcaaacaggcacaggaaggggaagtgttgtgatcaatattatccagttaatattagcattcagaggaaaatttgagtcctctgatacactgttaaatttctttctatactatcaagtccacaaatcctggaactgcaaaagaattttgagactgttcaaaataattaatctctgtataggctcaggctttcctgcaaggttatgaaatgctgataaaattggtcttattttgaaaggctcctcagcttatacctttccttacaaatgcttccttacaaatgctaaagcatttaatgactcctgacttaaagggaatttggacagattgaggttgttggtcttggaaatataatactgcaggcttctgtaaaatacttgaaatgtaattgttttaaaactttcaaagataccacttgtttgcctgttggttagaatactggtgaaataatttttaatcttttatgaataactaatttcatcataagaaaacttagctaagcatggtaaagctgttgttatacaactgtggaattcttcctgaggagtaactatcttataataaatgtagttgattatctaaagtagttttattcttggaatatctcataataggtttattctcttcttgtcagtatttccttgtagattgagcctgtggatttgcatttttgtaattgtgaatcaccattataggagatacatgcattttatctacttttcagtttgtatggggttaactttattagaattatctttaatgttattttgcttatatccttaattttaattatagacaaacattaagaagctggagaaaattatgttctagtgacatttatatagaagaagaatcttttttccccctttcttttttgaagggagatgaggcagtcatattttggtaaagaatttgtagactttgcagaggtctcttcaaaataatctggctcagagtcttgacatatcctcagcagacatggtgcaaattagatggcagagtggtgggtacaagttgaccataaaataacgcattaggttagtaatgcccaaataatactttgggttttcagtgttgcagagaagtcagacaactgatagttattataaagaaaaatgttctgagagtgaggtaaccgcttaagggaaggaagcctccttctgtcttattcactaatttacaagaagataattgtgttacacttccttaggagtcattcatttgtatatttgacacttttgctttatgaacatgtgaagattattcaaaagtaagctgttggtgatttttttcttccaagaaagcatgccacagggcaacttctagggttggttctcatctagtcctgtgctccacactatctgcatctgcacttaagtttcaatattagataactcacatgtttaaactatgaagaaagagttaaaacatcctgagaatgctagtaagtatgtatttttgaaaggacttccaaaatttgagtttaaagaggtaaactccttttacatgacaaagttacttagaaacactactgctgtttccctctcccttgccttctccctgtcccatgcatacccccagctgtgttccagaatgatggcacataaagtaaacattcatatttatttccctttttttgttttttttttttttttttttttttgcttgtttgttttgtttttttgtttgagacagtctcactcaatcacccaggctggagtgcagtggcaacatctcagctcactgcaacctctacctcctgagttcaagcgattctcctgcctcagcctcccgagcagctgggattacaggcgcctgcccccacgcctggctaatttttgtatttttagtagagatggggtttcgccatgttggccagactggtcttgaactcttgacctcaagtgatccgcccacctcggcctcccaaagtgctgagattacaggcatgagtcactgtgcctggcctcttattttttctttggttaaacttttagggaaaaagtttgagctgcttttaattttctttttgtttttaaataaattattaaagtttctctatgttaggaactcttgtgtacatgagttcattgagcttattcttaataaagacaaatcttctagaaataatagttgtatctttaaatgatctcaaggaaaatgtttggtttctctggggaatgaattttcatgacctaatcttaaatcaggttattttttctagcctgtttactaaatttctacatgttataacctaatgaaattttcttacttcctctttatttaaaacaaactataattactgtctttttaaaaatcttccaatgtggcgttcttatttttcttaacatttgaattttcctgggccaaaccatgttactatgatacacattatttaaggctgttatataatacagtaaaattgtagaactttcataccttgaaggatcttagcaattatttaattcaaacccattctaacatagatgataaaacagatttgcagggttgggcacggtggctcatacctatattcccagcactttgggagactcaagcgggaagattgcttgagcccaggagttcaagaccagcttgggcaacatagtgagaggctgtctctacaaaaaaatatttaaaaaatagccgggcatggtgtcacgtgcctgtagttccagctgcttgggaggctgaggtgggaggattgccagagcctgggaggttgaggctgcagtgagccatgatcacaccacagcactctagcctagagcctccctgtgtggcaggctctacacttcagataggcaacagatcgagaccttgtttcacaaaacgaacagatctgcaaagatcaacctgtcctaagtcatataatctctttgtgtaataataaaaaccccatcttctaaccttaaacctggtatttttttctacgaaactatgttctgcagtccaaattatttttctttattattttgaatcctaaagtagaaatagaaacttagaaaaataaaaagcaactcctttatgacatatgaggactttttcagttttaaataagaaaaacccaactcaaagtagcttaaataaaaggagacattttttgacttacataacctaaaagctctggcctggatctaggtgctcaacagatctcaagagtatctctcttattctctctccctcccttaccctcctcctcttttctctcttctgtatatatgttattttcaaacaggctctcacaagtagtggcaagatatagttcctaatagcttcaggtttgcattctacctactttagcaactatgatgagaagagagctacaatttgagcaaaaatttgtagggtgagttctgatttccctggattgaggcacatgcctattattcctgaaccaaatattctgtccagggaatggaattctctggggcatgtatctaaagctgaagtgtagagcctgccacacagggataataatagttttccaaagaaaaatcaaggaggggaaagaatgttggaaagagaaaaaaatatcagttgtctgcttcacatttgttctcaataattagtttcatagaagtgaaatactgtgtaacaccctaaactttagagattcttcgtagacaggaaaaataagaactcaatgaagttgtgacttcattcaaatcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagagattaatcacaagagatttacataaaacaactaaggttaaaaataaatggtggattagagatacatcaggcaaatttcaatttcaaaagcagatgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgtggtaatgctggtgtaagcaaacttactgtactgtcagttgtataaaagcatagcacagttatgttcagcacataatactttataatgataaacgaatatgttactagtttacgtgtttacagtactattattttagcatgtgcttctgcttattaaaaaatgttaactataaaataatctttaggcagatcctacaggaggtattccagataaaggcattattgtcataggagatggcagctccatggatgttattgccccttaagaccttccagtgggacaagatgtataggtggaagacagtgatattgatgatcctgaccttgtagaggccaaggctaaagtatgtatttattagtttttaacaagagtttaaaaagtaaaaaaaaaaaataaatttaaaaatagaaaaaatcttaataaggatacaaagaaaaaatgtttttgtgtagctgtgtaatatgtttttgttttaagttaaatgttacaaaagagtcagagttaaatttttttatatttataaagtgaaaaagttataaaatgctaaggttaatttactgaagaaagaaaaaatttttaaacagatttagagtagcatgtttataaaatctacagtagtttacagtaatatcctaggccttcacattaactcaccactcacccactgactcacccagagcagcttccaatcctgtaagctccattcgtggtaagtgccctatacaggtgtacaatttttatatcctttataccatttttactgaaccttttctgtcttttagatacacaaataacattgtgttacagttgcctatgatattgaatacagtaacttactgtacaagtttgtagcataggagctgtatcatatagcctgggtgtgtagtgaactataccatctaggcttgtgtaagtatattttatgacacagtgatgaaatcatccagatacagtttctcttaagcaacacataactgtatatatatatatataggtggctttaataataaaataatgaaatatatttctttttttctgtcattgacaaaacaattaccagtcttactaattagatcaactgcaaaacaaaatctcactcaaaaataaaaatatgtaagtcccattccttgattacaattcattagaactggagatttttaaaaatgtttaaatttatatggaaatataaaatcatgttttaaataatttttgattcaatgaggaaatgtaaatttagaactaaagattaataactagagatttataaaggcaaaaatgttaatgaattaggaaacagtaaaccatttgaactaatctaaatactgattgcatgaaaatgccaataaaatcaatacatatttttaaaagccagtcaaggataaaagaaaagagggaaactaaaagtgagacattaagtatgagaaaggagataaaactaaagtgtggaggtgatgttaaaaattatattcaggtctgtgctaatcattttggaaatttcagtgagaagtgggcaattttcagtgaatatatcattgtaaatgctttgaggagagacaaaatctgaatagaccctgcaataatgaaaatgtctaggagccctcaagaaatacctggtttaaattgcatttcaggtggctggttatcacaccttgaagtatcaagtaattatgttatctaaattggaccaggtgttagaaaaatatgtgagacttcacaggtggctgcttatgtagcccttataccttaatctgataaaggtagcatatatttaaaaagagagaaaaccagaaggtacaatttagggaaaattaaatacttctatttggccaaagtaagagtacattcaagggaattgtgagaggtaagagtggaaacagaggttggagctgtatttttatgctgtgattgaattacagtgtgtgataaatattgctcttatttgggtagattaccatttaacattttgaattaattggtaattggattaatcttaacttttaaaaaactaatctgagagtggtataaaggatagattacagaatggataaagggtgataaatcagttggctatggcaaaattgcaggaagaaactgaaataggccacagaaaactgaaactgacattttgagtagtatttcagaatcaagatctggattttggcaactgaatagatgcgtaggaatcaaagatgagtatactaaatgaacttaatctatgatttgtctgtcattttattgtgtaccattagtgtgtatgcatgtatgtatgtgccaggtagttaataggctgactgtgtctcttagctccactctgctgcctgggcctttgccatagtgctggagttccctcacttctcttttctgtaaccctattatattactgctgtctctcagctgtgtttcattcctcaagcagaaagaagatgggaggatcatatagtagttgactagaagctgtggagtttgagtgctgggattatatctagttccattacttatgaagattatatctagttccattacttcacctcatctataaaatggtttaccaatagtacctaccttacatggttttatgagtattaaattatgtatttctaaagacatttagaacaatacaaagaatatagtgtgggctcaataagtgacgatggtgttagttattagaaggccatcgagtgctggagaaaataattgaatatcattgatggaaataaaggaagttttccacgttaaaaagcttcggtttttggaaatgtgtgttttcagtatttctgagattaccaggtagaaattccagccagatgttggaattctgcactggcagttgggaataaagtcatgttaaaggagataagttttggagttattgtgtaaaattggtaaagcactggaatagattggtttgacagaggggaaactctttttgagataggcctatatttagggacaagagaagagacaaccaataagggttgaaagaaaccttgagagagtaagtcctatgacagaagcagggaagtttcagaatgattgcagaaagatcagccaggctcttcctgttctccatcgtggtgcaggatcaaggtgaaaaggataaccccatgcaggaattttgcatctgcaggctccgcttcaacatctgtttaggagaaagtggagacagactgacctgagtaactaaggtcttggaacagcttacaggtcagaaccaggtgttttccaaagctagatatactgttagcgcctttggcaacagaagaaatgaaaagactgttgtctgctgcacagttcgaggggccaaggcagacgaaatcctggagaatgatctaaaggtgcaggagtgtgagttaagaaaaaataacttctcagatactggaaactttggttttgggacccaggaacacattgatctgggtatcagatatgacccaagcattgatgtctacagcctggacttctatgtggtgctggaaaagccaggtttcatcattgcaggtaagaagtgcgggacaggcttcattggtgccaaatagaatcagcaaagaggaggccatgcgctggttccagcagaagtatgatgggatcatccttcctggcaaataaattctcatttctacccaaaagggtaataaaaagttttcagtgaaatgtttaaaaaaaaaataaaaaaaagatcagccagcagccaggatgggattgtgaaaacagcaggaaattagttgttgacaaagcattaatgaccattaagaaatcagcctcggctgggcatggtggctcatccctgtaatcgtaacactttgggaggccaaggcagatttcttgagtccaggagttgagaccagcctaggcaacatggcaaaaccctcgttcctccttaataaataaataaatgaataaataaacaagcaagcaagcagggcttggtgttaggcgcctgtactcctagctactcgggaggctgagggggttgaacctgggaggcaaaggttgcagtgagccaagattgcactactgcactccagcctgggtgacagagtgagaccatggcacccccctccccttcaaaaagaaatcagcctcataatcaatttctctggattaaggagtaagagcgtctcaagatttgctgtttatagagagggaggctaatagtttgagagagatacagaatctagggagagtgtgggtttttggtctttcagttgtttgccagccttggataaagaatgaagattacttgagcatattatttagagacaagtggagagaataaaggcacatgccagataggagataattaataaagcacttgtccaaaatagaaacttgttgaacaggaagagacgtcaagtataaggagattttaagatgggagaagggaattttgagtgtttgtattggatgacctcagggttcccagtaaagcaggagctgaattcatcgaaggtgatgtgttggtcaggatcaagagagaggttgggagaacaaagtgctaaaatcgttgtggtcaagagtttaaaaagtgtataccagaagagttattgagtgataggggtttgaaataggcaaagctgtaggaaagggggctggaaggaatattaggaggaacactaaatatacttctgaggtctacctcctggtctgtgaacataaaggagctgaaagagtaatggctgaagttctttagtttagctaaagttttttagctaaagctagaattgttgaaagttgtatttgaggaaaaaaagttaaggatacagttgaccgttcgataatgtagcccactgttgaccagaagccctacccacaacataaacaggcaataacacatattttgtatgtgtattatatagtatattcttaacaataaagtaaactagagaaaagaacatgtatcaagaaaatcataaggaagagaaaacacatttacagtactgtactgtatttattggtaccatacatttatgttgctgtttacaagatgaagcatctgtctgaaatggccagcagctacagctgtacctatctactgtacatatcaagcaagtcactttattcttataatgtctatgacttctttctttgaaagcgcttccatcatcactgttggcacttcatatgggtctcatggtgttaaggtttacggcattgcactagacacaatgaaaactacacaagagggccgggcacggtggctcacgcctgtaatcccagcactttgggaggccgaggcgggcggatcatgaggtcaggagattgagaccatcctggctaacacagtgaaaccctgtctctattaaaaataaaaaaattagccaggcatggtggcacgtgcctgtaatcccagctaatcgggaggctgaggcaggagaatcgctttttcccagaaggcgtaggttgcagtgagccgagatcgtgccactgcactccagcctggatgatagagggagactctgtcgcaaaaaaaaagaaaagaaaaagaaaagaaaagaaaaacacacaagagccgtgagagagatagcttttgattgcaatacacaatttactggagagatgagctgatcatacagagatgattagtgtcacacagtgttttaaacagattcttgcaaccctggagttcactgcagtagcaacagaagttagctatgagattttaacagtagtatagtatgtactacagttaatattaggtagctatgatttaatgctgcatctttgcatttgtttacatttatcttgactacaagtggtattatgtctggtcttaaggtttgtgtgcatatgttttgatgaattttaactttttataataggtttgtgtatattttatggcagtaaatgataaaacagactaatctacatatattttatgtagtcatgacataaacctaactttttcttaactttttgatatttctagtctatgtgtttcatctgcaggttttttcaaattgttgaaatctctgaaaaattttattgaaaaaaaatccatatatgtaagtggacccacacatttcaaacctgtgttcaagggtcagctgtgtaaataattttcctcaaaattaaagtggaaaaggagagttactactagtagaaagtagaactgtacccttgggcaggggtgtgtgtgtgtagttaaagatcaatttaacttaaaaggtcttggttagagaataaaaactggcccttattagctttaatttacatgaaaaatgaaaaattttaggccaggcacagtggctcaggcctgtaatcccttaactttgggagaccaaggggagtggatcacttgaggtcaggagttcaagacagcctggccaacatgctgactcacccttccctactgaaaatacaaaagttagccaggcgcagtggccatccctacagtgctagctactcgggaggctgaggcaggagaattgcttgaacccgggaggcaaggttgcggtgagctgagatcgcaccactgcactccagactgggtgacagagcgagactccatctcaaaaaaaaaaaaaaaaaaaaaagatttgaaaacagagtattttttaatctgcaagagctttacagccttttattcatatgtataagcttttaaagatgactaaaattttagtgtggactttccactcattggaaatcctatattgcaggtgttaattcaattttagtgagtgtgcatcatggctcagagagataggactagaatgaggaggtcacattggagactctgaaacagatacatgtgagcctcccaactttttaatatttgttaatctagaagtgttgaattttgggtgctgacaaggcagcaggtagataagaattgcaaagttaagaaaatagactgtaatattgatggtaaactaattgattaaattttaaaatgtacttttccatgtttttctttgaattgtcagtaattttgtttcaactggtattcatacatagattattcacccaatgttgacaactagtagatttatatattttttatgttgcctatccttttttgggtaaggattaacagaatgtataatcacctacattataggtacactactaatcacttgctacttgaaaaaacctaaagctttgaaatctttttattattgcacacaaacttatgccaaaaatggagataaagagaaaaatgtcatccactaaaccccaacaaataatgttgacaatgtggtctactcgtagactcgcattgacttaatttttttaaatcttattgcatattttgactagataataaatgcatatggttaaaaaattcacatggttcaaaaaagtacacctcccactcatcttccatgtgatatttcctttctgcttagcaattctgtatttatcttgctaaacatgaatgacagttgtttgctgaaattacattaaatgtgacgtaataaaatcattgtaagtttacattttttaactttaataatttttaatgttttaatgaagagtatgaagagtagtagtactgctcttcaaagtactactactttaccttaccttttactgttttgttaagaaaattaggccgggcgcagtggctcacgcctgtaatcccagcactttgggaggccgagacgggcggatcacgaggtcaggagatcgagaccatcctggctaacacggtgaaaccccgtctctactaaaaatacaaaaattagccgggcatggtggtgcgcgcctgtagtcccagctacacgggaggctgaggcaggagaatggcgtgaacccgggaggcagagcttgcagtgagccgagatcgcaccactgcactccagcctgggcgacagagcgaaactccgtctcaaaaaaaaaaaaaaaaaaaagaaaaaagaaaattatatagaaataaaattccagctattccaaaactgcaccttgaatacaggtacagaattgctaaaaccgtgtaccattttgtagttttagcatgcttttgtgtaactgcatctggtgtttgatcctcatgagagccctgttaaggaagggtacatattattgtcctcattttccttcgaaaacacatcagagtttgtattttgactgtcagcattcaaatacaagtcttttatttataaaattttggtctttatactgtggctaaaaatcttaaatcacttgtcatgatttgaaatggtttataccgattttttttgacatttatacacacatacacatatttttaaattgtctataataaaatcatgctcatctttgaaaaaatattaggagtactacagtggatacctacatacttgctattcagcatacctggttttttgtttgttttttgagacagtcttctctgtggtccaggttggagtgcagtggcacgatctcagctcattgcaacctccgtctcccaggctcaagtgattgtcctgcctcagcctcccaagtagctgggactgcaggtacacatcaccacgcccagctaattttttgtatttttggtagagacggggtttcaccatgttggccaggctggtctccaactcctgacctcaagtgatcagcccacctcggcctcccagagtgctgggattacaggttgtgagccactgcacctggcctgtttttaaattcacataaatatgttttatatttttcattagggagaagaaggttgtgtctacaatttttaagacattggggagatttagatgccagtagtaacttaaaagagaaataattgcaaattctttttcctcttgagtatactttcatttaaggtacagtgttctgtaagttacttttaccgttaaacttcttaatgttgcttattgtttgtcttacatttttaggttggatttttcttaagtcacatgtctaataaaaaaaacccttaaatacctcatttattcgtcttcgttagtgaatgcattgttgtacatattagatttttctctttagataactcagcttcccctattaagtgccacatgtattacaaaattttatttatgttttattgtttaataaactcttgagaactagatacattttaatcatttgtaatacttacattttctaaaacacttcatttttccctggtttcttcaacaaagagatgcatgtagtacaaggatagctttacctgtgttagaagattgtttcacacatttacatcaactgcatagtcctgtttttgttgggccctaatgccagcatcactttttgctactgctgtttctgccttaaaggcaatatgcctctgtctagtttgctgattctgatactctttcccctggaaagtaggtaatcaagtttgtgaggagctgtgtgtttaaggagtccataaatccttgtggggagccctaggtgtatagagcatagctgtagggcagaggcctttgacacttattctggatatgcagtggcctttgcctatggggttcatgggtcagagcgctgttgtgacctttgaataaatgggttgttatgataattgttttaagggaggagagttattctgatatcctttgtattgatattgctcttatttattattgagctggatttaagtattaatcatttaaggtcaaatttctaatgtatatatgttcttaaatggctacgacccagttaccatagcaatttagtgaaataactataatggaacattttttttcaatttggcttctcttttttttctgtccaccagggagtaactattcccagtcagaggcgctatgtgtattattatagctacctgttaaagaatcatctggattatagaccagtggcactgttgtttcacaagatgatgtttgaaactattccaatgttcagtggcggaacttgcagtaagtgcttgaaattctcatccttccatgtattggaacagttttcttaaccatatctagaagtttacataaaaatttagaaagaaatttaccacatttgaaatttatgcaggagactatatttctgaagcatttgaacaaattaattagctttgttgttcaactcattgggctaaagaagccaaaagcaatgggttttaatgtagtcgaagccaaattatatttatgaaagaaatattctgtgttataaccaccaaatacagcccaattctgactagatgatggaagaacctgtcccatcagaggtccagcatgaggtccagcagaggtccaccagaggagttcagcaatttgctgctcttagggcagggatcaattccttaatatcttaggaagactaggtattgacagtaatggtgacaaagcaatgaaaaggaaaggaagaagtgataagacgtggcagcaagctgaagtatgatgagtaaagaataggaatcaaagtatgtggagtgttagagaaaacctggatttagatccagattctagtcctatctctgtcattaatctattgcgtaaccctgagcatatcatctacctctctttgagtttgcttgtcaataaaatgaagagactttgaaatctgagacttcctggataagtactaaatacagattatgtcactgatgtctgcctctatttatttctcccttttaccctaatctctataagtctacctcagtcatcctgatcctattctacttctctgatgttgttgtcagataggtgtgatcatcctcatcagatcttttctgtattcttagagacagataactttatcaaagaccacagatttattagtatagcatgttaaagtcttctaaagagtctcattgatgctcttttcatctcagtacaatttttaaaactgctgaatgcaaggtactgagctgttggaagtgactgacagatgaatgtaacagattcatagagaaggaaaaaggaagaaaaactcatgctcttcctatagtattgatatcagtgtaagagccaagagaaaggtataaagtatcatgcagatattaagggaaagaaaacattcactttagtaatctttcctcattttctagtttcctcttatgtactatgatttaatactgtagtaaagttttaataaaatatgagctatatgtaattaagtgggaggttgtggggctaggcacgaggctcacacgtgtaaccccagcactttgggaggctgaggcaggcggatcgcttgatctcaggagttcgagaccagcctggacaacaaggtgaaaccccatctctactaaaaacacaaaaattagctgggcatagtggcacacacctgtagtcccagcttcttgggaggctgaggcaggagaatcgcttgaatccaggaggcagaggttgcagttagccgagatcatgccactgcactgcagcctggacatcggagcaagactttgtcttagaaataaataaataaatataaaataaaataaatgggaagttgtgtatataaattataaatgctacattcagaaaagcttttgaaggttgtcagacagtttcttaaaggaagttcaccagttctttattgaacattgaagaaaacatacagtttagactggcattaaaactgaaagaagtggccagacgcagtggtagacgcagtggttcacgcctgtaatcccagcactttgggaggtcaaggtggatggatcacctgaggtcaggagtttgagatcaggctggccgacatggtgaaaccctgtctctactaaaaatacaaaaattagccaggcatggtgatgcgtgcctgtagtcccagctacttgggaggctgaggcaggagaattgcttgaagccgaaggtggaggttgcagtgagccgagattgcgtcattgcactccagccagggcggtaagagtgaggctccgtcttaaaaaaaaaataagtaaataaattaaaaactactgaaagaagtattacaggcaatgggaaatagcttgagtggaagtgcagcagaaggaaaaagctggacaagaatgtagtgtcagagaataggtatggaacgtgtgagtgactgttagaggatcttgaatggggataacagacttgatttcataaatactgagatgtcatgataatacttgaggactaaaccatgttttaaggacagttgtatgcaaagttgtaatcgcaagaggaaaaaatagtggaaaagaaaccagtaataaaacttgccttaatgcaggtatgctaagacaatcaaatgggatttcattaattttttatttgccatttatagccaaagattttgtaaaagttttgagcccagtcaggtgaaatagtctcagaaagaaagaaaagtgaatctgagacttggagacattaatgttgatattttggttttaaacgtgttttaaatccggtaaaagtgagcttctcacatgacaatattcagtgggtacttgggagtatgggttcgaatctaggtaggagatatatcgatattttgggcatcatcaggaaagggagagtagttaagcctttcatataaataatggtgtggcgtttgggcatgggaagtcttggaggaaaggaagaaaaggagagggtgaggactgagataagaatggcaacttgggtttaggaagaagaagaggaatcaatgtagagaacagatagtgctgaaaaatacagcatcttctgtagggattggcagctttttcttgatttttgtcttaatatttctaagagatggaaaaagctactatattctagacatttaacagggttaaaaatgttactaaaagatgatcaatgtggttttcattcaagactataacaatatgtatatatccaaggaaatttaattctgacttaaaaaaattgttttgcttgtatagatttagggacacaagtgtaattttgttacatgcatagagtgtatagtttcaagtcagggcttttaggttgtccatcatctgaataatatacattgtacccattaagtaatttctcatcttctactcaccgtttcaagtctccactatttatcattccattctttacattctgattttcatttactaggtgtattagtctgtttttgcattgctttaaagaaatacctgagactgagtattaaacaggtttaacctgttttctttatgaattcttctttaattggctcatggttctgcacgctgtacagaaagcatagcagcatctgcttctggggaggcctcaggaagcctccaatcatggctgaaggcaaaaggggagcatggtgagaatgggagcaagaaagagaaggagtggtggggagaaggtgccacccacttttaaatgccagctcacttaccaccaagaggatggcccaagccattcatgtgggatctgcccccatgattcaagcttcttccaccaggccccacctctagcactggggattacaattcaacctgagatttgggagggaaagatatccaaactatatcactaggtctggatcttgttatttattttttggaacatagtcatatatatccaaggatatatattgtagaagtccacagaaccatactaatattggacttctgcttagttaggtcttatctatctgaaacatgatattcatattgcagagaagattattttctttagtgattgaggaaatctttactacttatacatttttaatataatactataatatttgaagatgcacattttagatgtagtttaattgaaacctggaaatactattaatttgctttttaaagtcctaaaatcaggattatcagattctgaattaatggagtttaaatcaaaaagattacaaggcagtttttcagttttattctggttaattttatcacagctttggaatcctactttgtttatttgcttcttgaagttagatttcccagtgaaatttcagtatcacataaagtcttatgaaatggctcattgcactttgaactttgagtcaaggaagtgaaatttattgatagattgttggtgtaatatttatcctgtttgtggtagcttttttgaataataagtgtcttagaagaccatgttggagtagcctgcatgcttttatcaaacatattaattatgtgatggctgatactgctttagatattacatagaaatagtagtaggtgtttactaaactggaaatttcatttaacttggtttagctttgccttgttctcagtcacattgataaaaatgtaagacttttgtttatcttttagaataatgacaccttttggtgctgagaattttttgttttatatatatatatatatatacgtaatataaatacaaaatatatttaaatatgtataatatttctcatacactttatgtaactttgtgttcctgtttctctattatcttggcatgttttcttcaaatggcacttcttaacctcctaaggttaataaatttctttgtaatggacttttgttttctaattcctcagcgtatgacaaatgaattatactttgtcaaattatttaggtaactttcagtttttgaagtcctgggatcataacattcatcagtctttaatttctgtcattaaggtcattagctataaatgaatttatgagtagatttaaaaaataaaacatacaatccttcccttaacacactttcccaccatttggttcaactgctagtgtaaaagcatgatgaattttgagaagttatattttaccagttactttattttttaccagttatttaaaacagacatgagccaaagccagaatacttgttaatgaaaatgaggtgttttggaggaaaggaaggttgtgctgcagtttttacttgaaatctgttacatttctttacagaaatttcaaatctcttgtttcctgttatgatggtggcattatatacctttaaaatgtgagctataggaaaatgaatgatggttaattttttaataaatatttagacttgtgtttttgaaattttttataacattgttataggttttatcctctttctcttgtgaacatgtagtgatttgtattttgtgatctttgccgcatgctagagacttaagaatactatagcaaatatctgtcttctttacatttaaaaatttttcgtgactactccctgttgatatctgtcttaaaagttacttttgatgtagttcacaaatgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactatgttgcccaggctggtctcaaactcctgggcacaagcagtcctcacgctttggcatcccaaagagttggaattacaggtgtgcgccatcatgcctggccttaacgtttcttaagacttgattattttctatttagcttctgtggatttactgattaattttttaactaggagagaaatcagtatgaagaggaagtaataaagaatgaaaacatggtatttaaatgtgcaggtttagaaagttaatgaagtttgaatttgattgatctgtatttagagaaggcaacgtcttattattttaaaaccaactatccgccctgtgcggtggctcacgcctgtaattccagcactttgggaggctgaggtgggcagatcagctgaggtcaggagttcgagaccagcctggccaacatggttaaaccccatctctactaaaaatacaaaaaaattagccgggtgtggtggcaggcgcctgttttcccagctactcaggaggcttgaggcaggataattgctgaacccgagaggcggaggttgcagtaagccaagaatgcaccattgtactccagcctgggcaacaagagtgaaactccatctcaaaaaaaaagaaaaaaaaaacaacaactatcttcatttaaaatattaaatgtgaatatttaaagtgagactaaggtgcaacatttttagatagtaatgaagaaaaggactaactttgtagtgttgctgccttgttaaacatactagatagcatattgccaatctttaaacattctcaatgataggatttatttactttttctgatttttagcttttcttttgaaagaaaataagaggaagtttcatttactgcaaaattttaaatgctgctttgatgtatcagtagagatataattttcctttatccagaatccaagtagctggaaaaaaaaatcaaaatatgctgaacttttttttttttagccagaaacccatttcctatcgtctgtacaaataaaagttaaatatatctcaataacttagaaaaattattttttgataatccaggaagtattagcaactgttttaaaattaagataactagtaagttttatttagctttcaaaaataggcatctacatcatcatctctgcatacctttaggaatttcctaattcttatttcccttcatctgtactttaacacatgcaaaattgaaggttagattaaatatttatgatttatttgtttatccttgactacataaatttccattttattgattttccctgccttatttaagaatatgctatgattaaaacacaaaaaattttagtataacccatatatatatagaattcacctttttgttatttaaatattattggcttattttcttctaagtaaaatacaattactggctaaaataattgaaataagcaaaaaaaaaattttaaagaccttgtatacaagattactttgccaggtactgttaaaagatgcaatgacatttaagacgtaacatccttaaggatcttattttctgggggataaaaaactttaagataaattagaataaaagatttaaatggcattttaaggtaccaggtaccagataagatgtcacaaggctgtatatcattaattgccaaatgatttatacaggccagatttctttgttggtcaatagaggtttaaagtgatgaacttctgttgtgtttttttattaagaaggtattatcttattagtaagaagtgattttttttaagaacaagcattttataacatcaaaagaaatcagtagtactctttcctaccccctcatatttattctgaaagtattcaagcattatattgtcatgtaagaaactggagcttctcatgtttgtattgctgtagaagtaaacatgtatttgccatgcgtcatcagggaagttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattcttcgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctacaaggcccagcataatttagcacagggctacctcctacatcagcactagtcaccttctctccttgtttcttgagattcagtcatactggtctttcttcagttcttcaaaatgctaagcttctgcctcttctagtctttccagttattttccttctccctgtaccttttcatctcagccttttcccctgaccttccatagctatcttcatatttccagccttagcttcaatctcatattctctgaagtcctttgattgtcctcccgttattctttttttaaaaatcctatttccttatattgtatcttagaattatttggtttgtttcatttttgcctatgtgtgatatatgtatttctacataggtatatatatctacttatagacaagaattcttcagattaaaaaaatctgatttgtaaacattcccaagtggttgtttaccatttttttcttcccccttcctatttcttattctacctgattttcccctgttcattcaccacactcgtttctttctcttttttactctctcttaatttttcattcaatttttataacatgtaataaatctaactgtagcgtctgagtattaagaatattgctagtaatacttcacctgtaatcccagcactttgggaggctaaggcaggcggatcacttgaggcccaggagtttaagaccagccggccaatatggcgaaaccctatctgcactacaaatacaaaaattagctgggcatggtgtcgcacacctgtaatcccagctacttgggaggctgaggcacaagaattgcttgagcctgtgagatggaggttgcagtgagccgagatcacaccagtgcacgtgcacttcagcctgggcaacagagcaagactctgtcttaaaaaaaaaaaaaaaaaaaaaatatatacacacacacacacacacacacacacacacacacactattactaccaatatacatacatatatgtatgtatgtatgtatgtatattggtagtaatagtaatacttgggcccctgcacgttttaagtgaaaatagatctaatattaaatgtctttagcccttaaattttttttaagtgttcagaagtttccctttaaaaaaatttttaatatataataattgtacatatttatgggatacagagtgatattttcatgtatgcagtgtgtgatgatcaaatcaggataattagcatatggatcacctcaaacatttgtcatttctttgtgttaggaacattcaaaattctgtcttctagctatttgaaaatatacagtaaattattgttgactagttacagttctatagaacactataatttattcctcctgtgtgtaattttttatcttttaaccaacatctccctatcctcccctcccactccctttcccggcctctaataaccacactcttatgagctcaacttttttagcttccatatatgagtgagaacatacggtatttatctttctgtacctgacttattttacttaacatcatgtcctccgggctagacattctctttagaatccacaggtttcctttcttttctctaaatctgcattttgctcagccattaacttttaaaatgtctttttccctttagttttattgttttctattttaatattgcaagatgttttatatttgtgattacaaataaaaactccattattagtaaacaaatacaatgtcatatagtagtaagtgctataaaaaatagacaggatagaaagtaatcttggtttgtatgttttttgttttttagcaaagatgattagagaaggcccaaccaagcagataacatttaagcagaggcctaaatcatataagtgagttatacaaatatctgggaaaagagttaagagtacagatgcaaaagcccttagacaagagaatgagcttggtatatctgaagagtggataagtcattttgactgaaacagagtggacaagaaaaccagtccaagtgtaaagacactagtgtgtgttcagcataggaaggatgtaatctgaattttgtgtttaatattccctgtgttcatgctttcaaaatacagatgagtgaggaaagtagggagaaggggtaataaaggaagctgagagatcagttaagaggtacttgaatagtttagtaaagatgagagaagatgtttgcttcttgttgcccctcactgcttagaatagtggcagtgaagggtaacaagaagctgtcagattaacttaaagagtttactgatgcagtggatgttggttgtaagagaagaattgataatgactcttggataataggggagggaggggctgtcaatataatataatgaagaagggatttgaagtcatttctgatttaaatctcacatccactacctacttttaatagatatgtagcctttaacaagttccctaacctttctgggccttagctacctccccttggaaatggaaatacctaacatgtaaggttgttttgacagttattttcactaggcatgtaaaggcacttgactctctgttatagaccactgtattatgttaatgtccctctccttcctccctttaggtaaagtttttagggctaataaatcccaaatatcaatgttgatcagtagtttgtgtttgtgtagtgttgtttatatcaaaaactacattgaagccgggcacagtggttcacgcctaaaatcgcaacactttgggaggccaaggtgggcctcccaccttgaactaaggagtttgagaccagcctgggcaacatggtgaaatcccatctctacaaaaaatataaaagctagctgggtgtggtggcatgcacctgtagtcctagctacttgggaggctgaggttgatcctgggagtttgagcctgcagtgagctgtgaagatgccactgcactctagtctgggtgacagagcaagaccctgtctcaaaaacacacacacacacacacacacacacaaagaaatacattgatttttcacataggtagtaagagaaacattctttttgaactcagctgtttgtgaattgaattttgtaattcaaatgctatattatgtaaactattgatgactttcaatctgcatttattttgtataattatttagttaatatttgccacttatattccttaaaaaataaaattgaggttgggcgtggtggctcacacttgtaatcccagcactttgggaggctgaggcaggcagattgcctgagctcaggagtttgagatcagcctgggcaacatcatgaaccccatttctactaaaatacaaaaaattatctgggcatggtggtgtacacctgtagccctagctgtttgggaggctaaggcacgagaattgcttgaacccgggaggcagaggttgcagtgagccaagatcatgccactgcactccagcttggcaacagagcaagactcttgtctccagaaataaaaataaataaattgtattaacatcctgatagtttatctgtttagtacctagcaagaaagaaaatgttgaacatcttaagaagagggtcatttaaaaggcctcttaaagatcatgtttgttacagtgcttaaaaattaatatgttcatctgcaaaatggaataaaaaatctgttaaaaatatatttcactaaatagtttaagatgagtcatatttgtgggttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtca

SEQ ID NO: 1925 - DNA, 56203 bp, Homo sapiens
agaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctgtctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccggattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaagacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccggttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcagtctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaagaattctcctgcctcggacttctgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatatatatatatatatatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaactagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctctttccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgagaggctgaggtgaaaagattgtttgagtcgaggaaatggatgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatctattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttattta

SEQ ID NO: 1926 - DNA, 118508 bp, Homo sapiens
agaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctgtctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccggattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaagacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccggttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcagtctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaagaattctcctgcctcggacttctgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatatatatatatatatatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaactagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctctttccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgagaggctgaggtgaaaagattgtttgagtcgaggaaatggatgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatctattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttactgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacgtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtctgaggaagattgcatatcatcaactaagaattatatcaaggaatgaatagttttccctcaatttatacaatgtttagtttaaataacttgaaataaatctttgattcactttattattttaaaaacaagcgaatgtcaaatcaaacgaggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctacttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacccaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttggcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcgctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacacgtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctaacacttaaaatactttatactatatccaagtattgtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcacttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgtttttctgtatcatataactttttaaaaaaattttattattattttttgagaaagagtctcgctttgtcacccaggctggagtgaagtggcgtgatctcggctcctgcaacctccgcctcccaggttcaagcgattctcctgcctcagcctcccaagaagctgggattacaggcatgcaccaccatgcctggctaatttttgtatttttagtagagacgggggttcaccatgttggccaggctggcctagaactcctgatctcaagtgatctgcccaccttacctcccaaagtgctgggattacaggcgtgagctactgtgccaggcctatattatataactttaaatagtataggagtgatttgttcctgaaaaatttgtcttcattcctttcatgcagagaaattctttaagactcatttatatcttctttcaataggattagtcttttcagatattttactctttttgagtgagtgtgctatatatattttttcaaagaatagtcaacctaaaagaaatattttcttattgtcacatcattgtgtattatacttcattccccactgcttctccagtgcccattaagctccaggtgcactggtttctctataatttctcagaggcacctaggtgttactctttttagccacctccctccacgctcttcccacttcctagaatatgcctctcccactcttcaaatcgtataagttactatggaaaaatataggtgtacatcatattaaaatacaaccttaacgttcaaagtaggagataattattcagtttcgaattctcttcccccaatcttcaaaagatggtttttgttttctttattatacttgccataccttcttattatgcttatttctgtctccactatcatgttttgtgttcactccttcatgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataaaagcttagatatatatttgtcagatttattatatttattattattctcttttaatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattttactatatatccatttgcccttaaaaaaatgtatgtgcattttatgcataattctagtaaacagcttatggttgaatttccttttttaattaaatattagcctattaatagggaattttaactttatgaatattttgatgtattggattttatttcttcatccagtttcattattttaaataattatttaataattgtttaataactataaatatttttattgctaagtgagataagatatctttttgattgtcttttcaaatatatttgacaacatactgacataaccttgaagtttaaagcaaatcagcatacttttattgtatgcatggtatgaaagataatataaatgttttacattgtgatatataatatatatatatatataaattcacattagcaaactaattattttattttttgttactgaaattcaggcctattttcacaatggagactatcctggagaaccctttattttacatcattcaacatcttgtaagttatcactgggctatttattatatatattaagatatatattaatgcttataaagctatattattttacacttataatcacatttgattgttaaatgcttaaataatatctcttccgtaaatgtaatatttttaattgtcagtaaaaccatacatatatatgtaaatatatttaaatacaatatcttaaattcaagttaggagattcaattattaaaggtttgttgaattcataagaggatttatatacccaaactattaaattatgtttatgtttatgaaatatcgtcatgttagtaacatttttcgtgtactattttagattatctattttattctgtctcttcagcatatgtttagcagaagtgggccttagatacaagtctgtcttgatttacttaatggaagctaatataagcactccctaataacaatatacttatgtaaatatttatcactgatatttaaaatattttcatcaaagtaaaggtgtacatgaaaaattacttagaattaaatttcattataataatgaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtactctactttgggctttctctactggttaacattgtaaatagaattatttaagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaactccctgtgttaaatgtcaaaaaagtccagcaagatagctttgattttatttccacattacctttttcttttataatatctttataataaaaatgacttcattgactctttcctattaaattgtaaataatttatagcagtcatagactcagctgaacattcacactcacatcttaataggccagatctgaaacatttcacctggaaagacacagaacaaaaagcacagcatgctagcaagggagcctggcagtgggaatccttgcagcgggaatccttgcagcagtgcacacagcaatccagctacttttcttatgacactctcaaagacaactgagatatgagagaatgagaccacatgtgtaggtgtaggagctgcattccaaaaggaatcagtatctcttatactatttccatgggcatagcttccagacatgccaacaggggtgtgctcagttatgagcgggcactgcactcagggaaacccaaagctggtacttcccatgaggacaatagagttcacatatagcactccctgttcaggtgtagtttagcaatcaagggtcattttgccattagcaatgttgtctggtaaccagctaatattccacttttatcaggtttccaggtcaacggagccaaaaaattagccctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatacaaaaaaaatttttattctgctctggcacttgttcagtgtatcgacttggtataaaattctaagttaaaaattttagaatttaaaaattatttctgtcttattttcctgaatccaattttactttctaattccatcctgattctctctctctctctctctctctctctttttttggtctgttcccaagttttcctcccctggaaatgctaggtttctgtctttattcttggtcttacctgaattttttgtttgttttgttttgtttgtttttgtttttgtttttagagggagtttcgctcttgttgcccaggctggagtgcagtggcataatctcggctcactgcaacttctgcctcctgggttcaagtgattctcctgcttcagcttcctgagtagctgggattacaggcaggcaccaccacacctggctaatttttgtatttttagtagagaagggatttcaccatgttggttaggctagtcttgaactcttgatctcaaatgatccacctgccttggcctcccaaagtgctgggattacaggtgtgatccactgtgcctggccctgaatctttttcattcattttttctggatgctattgacctttgtaacctgaagatttatatatctgagaattctttgctccattttcttcccatagtctttggttgagtctattagtcataaaactcataagttgacttattattttggcattcccctttggtgttgatgttttccttaaaagcttggttcttattggtagtctagtcatagtcacagtgagacaacaggaaaggttgattagatgttctgtggtccttagaagatcttggtgactgaggagatttcctatgatattgctgatttatttttttctgatatcattcattatcaccaaaaactaattaatccccagaaattaatctccagaattaccctactccttgttgtgtggtaaagtgtgaaaaagtggttcttctcacagtaggacaggaagataggtgtccaactattgcatatgtggacaattacattgtcctcctaattttagtcctgtgcctcatcccttccctgtactgagcctgactttattctcagtctctcactgctttcatttaattttccttttgtcttctcctccctggtagtattttttcaagaagatattttttgttattgttgttgttgttgttattgtttttgtaaatagacatttgacttccatgttctgacccatgattcacatttactgcatatgtcactttcaaacctgagactcaggcattctgagtaaatggaatctattcctttgatttaggctgtggcctcctttcttttgttttctaccttctacaacttgttgaaattgctctacttctaatttcccttctctcattttcactgtcattataaatctatggcattttcagttttttaatattagcagggttcctggaaagaagggggaaacacatgtgtgcttagaatgcaagctttatctgaagacttggctattttattaagtttgttgagaaaagtctgatgctgcttaatatttttgtagaacttaatctaattattatggattggaatgctaacttacagtcatttgcagtttcttgcaaaatcttacttcagagtattctagaagttagatgttgcctctgatgaggtttttattcacaaaatctggaaacaatcatgctgattgatatatgtatactagtaatcactggtatggattgacaatttcagtgaaaggaatttcagatagagataagacaaggaacactttgggtcattttaggagcctattgcaataagaacttcttccctaaaaatgttcactgcaatccacctatatattcacattcatgtatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgaatgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcatgctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttattaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaa

SEQ ID NO: 1927 - DNA, 118508 bp, Homo sapiens; identical to SEQ ID NO: 1926

SEQ ID NO: 1928 - DNA, 54237 bp, Homo sapiens
agaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctgtctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccggattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaagacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccggttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcagtctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaagaattctcctgcctcggacttctgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatatatatatatatatatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaactagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctctttccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgagaggctgaggtgaaaagattgtttgagtcgaggaaatggatgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatctattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaa

SEQ ID NO: 1929 - DNA, 5294 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaaaaaaaagggtcttgtctgacagagagttctggggatggaattgtttcttggcaaatccagccatatagatctaactgctgtatgtataagacaccacctgtaggagcgggaaggtatcagtgcttcttatattgtaaagcattggcctaggaaggcaaacagttgtctttttgaaggatttttttctgctggtcctttgggttttgatttgatatttttatgctccctggttgagtgtgttgtcttcgtttttgagatctactgtatgtgttgaataacaagctattttcattgtactgtgcattttcccattaaattgtttgcttttaatattcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgtttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggccttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagattaaggatttttataattgtttttcatcaaattttaatatttttgtcaaatttttaggtatttaatttgtaaaacagtttgctttgtactggcatacagaaaatagggtattgattttaaactttttgaagccaagtgatcaagtacatttgtaataaaagtcaatggatctata

SEQ ID NO: 1930 - DNA, 86849 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatcgctgtaaaaacccacaatccagctaattagtctcagctgtttgtcatatggcactgcagaccagtcaagtgatttttgcccctttcaagcttaccaagttccagttcgactggccactcagagggcggctttattaacctcttctggtgttagaagactctgcacttcagctctttcttccgcccacctaccccgtgaatcaaaacagtagaacatttgttttcttgagaaagtgccttgtattctcaaggcccttaaaggttatattcatattgttgcttacaaatacaatgcctgatccaaacaaacaatatgggggatcaaatggaagtggcaggagggatggggctagattacttaccagaccttgcagctggcctccaatttcataagtaaaactgcctacaagggagtccacccagatatcttgctggcatctcaaatccagcatgtcccgtactcacctcctttgcttttctccacaaccttgcttcaaacccacttctcttcctgtgtcttgaatcacacaatcccaacacagccagaaatctgatggctctcattaactcctccctctctgcccctcccacttccaattggccaccaagtcctaaggatattcatcttcttgctcctactccaagtttttattatttcttagatggctataataaaccacttatttggttttctggtccccacgtattcttgactctgatccatcctccacaccacacccaaagtgatctttccaaaaggcaaatgagagtccatcactctcctgttaatggctccccacaatctccacaataaaatccctgctccttaagcttctgccttcagtatcaccgcctccttcctataagctgctagagtccagccatcagtacgttttataattcgctaagttaagtggttctcaaactgtggttccaagaccagtattatagcatcttctaggaacttattagatttgcacattcttgggcccacccagctgaatcagaaattctgaggatagggcacaggtgtctgtggttcaacaagcactccaggtgattctgatacacactaaagtgtgagagctgctgctgtaaatccaccaagttctgttcactaagagaatcagctccttggctccttgtgccagcaatgctgagctggatacaccttccctgtgcttactgtttctagaaatggtcacccctgtatgctaattattcaatttatttcttggtctttgctgttgctttgtgacaatcttgaagacaggggttgtatcttgttttttgttcattcaccccacaatcacttattgagcacttatgaattattgggtgaaatgtcggacatagaactaatcaatctatcccttgcctctaggagaagctacgctttcattatggcagctcaacgtgtgactgaagactcaatctgtccaatctaaaaaaaccaccaccggcctcaagaactgtgggcaactaagaaaagtctgagcacaaccagtctgacatctcttctcatggtaaatgaaatggaattttcgtttcacacctgacgaaaatctcatgaaaatgcacctctttcttttttatatcacacagcaacctcgagaattttgagaacaatttagtaagaaaatgtatccagatttttaaatcccagattaaaattcattagagttagcttcctttaattacaagttcatattagcacttctcaaccatcaggatatataggaatctcctagggatctttcaaaatgctaattctgattcaatattcctgtagggggagatcgagaccatcctggctaacacggtgaaaccccgtctctactaaaaatacaaaaaaattagccaggtgtggtggcgggcgcctgtagtcccagctacccgggaggctgaggcaggagaatgccgtgaacccgggaggcggagcttgcagtgggccgagatcgcaccaatgcactccagcttgggtgacagagtgagactccgtctcaaaaaaacaaaaacaaacaaaaaaaatcctgtagggggctcaggagtctgtatttctcctagtaagcacccaggtgatgcccaggtaatactaacattcctaactctggaactataatttgaatagcaagtaaaattatgacaataccaattttcatagtctgcttaaagcaacaaaaccttttttggatgcttttgtattgaaagctttctaaaatatctttcagacttcagaataaagatggcatgctcaacatgtacatgtggttctgctgcctcccaaaatctcactaatatagcaataaagaatgttttatttcttttagacataaactcacaaggacaaagatcaggtagtggaagcaacaaaatggtagaagctacagagtagatggactagaggtaactgattagcagacctcggaaagctgactctttatctgccagtagggaaatccaagaaggaactcatcacagaatctccagaaagtctcagggattcagaaccccaaaacttctggaatttgggggacagtaacatagggactcaaaacagacagaatggtggtcatctgcttaaaaagcagctcagcacaccaagagaagaagaaaagaaagaacgaactaccaaatagaaaataatgaacaaaatggcatagtaagtccctatctatcgataattactttaaatgtaaatgtattacattctccaactgaaagacatagaggttgggcacggtggctcaagcctgtaatcctagcactttgggaggccaaggcgggcagatcacttgaggtcagaagttcaaaaccagcctagccaatgtggtgaaactccatctctactaaaaatacaaaaaaattagccaggcatggtggagggcacctgtgatcccagctactagggaggctgaggcatgagaattgcttgaacccgggaggcggaggttgcagtgagccaagatcgcgccactgcactccagcctgggcgacagagcgagactccatctcaaaaaaaaaaaaataaaaataaaaataaaaaataaaagacatagaatgacagaatatatataaaaaataagatacaattatttgctgcctgaaagagagttgctttagatttaagggcagacagactggaagtaaagggatggaaaaaaatatttcatgcaaatggaaaccaaaagaaagcaggggtgactatacttatatcagaatagacttcaagtaaaaaacagtcccaagagactaagaaggtagttatgtggtgacaaggaggtgaattcatcaagcagatataacagttgtaaacatgtaggcacccaacatcaaagcacctaaatatataaagcaaatattaaccaaactgaaaagagaaatagataaccatacaataatagtaagggatttgaataccctgttttcaacaatgaacagatcatccagatagaaaatcaataaggaaatggcagatctgaacaacattatagaacaaatggaattaacaggcacatacagaactttctatccaactagaggagaatatacattcttctcaagcgcacgtggaatattcttccggatagaacatacagtaggccacaaaacaagtctcaacaaatttaagacgatcgaaatcatattaattatcttttctgaccacaccgatatgtaactagaaatcaataacaggaagaaaactgaaaaattcacaaatctgtggaaatttagtaacataatcctgaacagccaatgggccaaataaaatcaaaaggaattttttttaaatcttgagatacatgaaaatagaatacaacacatcaaaattttaggggattcaggagaagcagttttaagagggaagtttacagcgataaatgcctccattaagaaaaaagaaagatctccagtaaacaacctaagtttatactgcaacaaactagaaaaaaggtaacaaactaagcccaaaattagaagaaagaatgaaataataaaaattggagccaaaatgaaatagagaccaaaaaaacagaaaagaaagaaaagatgaataaaactaagactgttttttgaaaaaataaacaaaattgacaaaactggctgggtgcggtggttcatgcctgtaatcccagcactttgggaggccaaggcgtgcgtataacctgaggtcaggagtttgagaccagcctgaccaacatggcaaaaccccgtttctattaaaaacacaaaaattagccaggcgtggtggcaggtgcctgtaatcccagctgcttgggaggctgaagcaggagaatcacttgaacctgggaagcagaagttgcagtgagctgagattgcaccactgcactccagcctgggtgacacagcaagaatccgtccttaaaaaaataaataaattatatatatatatatatatatatatatatatgtatagagagagacagacaaaactttagctagtctaaaaaaaagagtaaaaactcaaataaataaaattataaatgaaataagaggtgttacaactgataccacagaggtacaaagaataataagagatactctaaataatccagtcgggcgcagtggctcacgcctgtaatcccaggactttggaaggccaaagtaggtggatcacttgaggtcacgagttcaagaccagcctggccaacatggtaaaagcccgtctccactaaaaatacaaacattaactggggcatggtggtgcacacctgtaatcccagctacttgggaggatgaggcaggagaatcacttgaacccaggaggcagaggttgcagtgagtcgagattgctccattgcactccagcctgggtgacagagtgagactccatctaacaacaacaaaaaaaaaaagacaaaaaaaagtgggattacatcaaactaaagctgctgcacagcaaaggaaacaacaaaatggaaaggcaactggccgggcatggtggctcacacctataatcccagcagtttgggaacccaaagagggcagatcacttgagggcaggagtttgaaaccagcctgaccaacatggcaaaaccccatctctactaaaaatacaaaaattagctgggcacggtggtgggcacctgtaatcctggctactcgggaggctgaggcacgagaatcacttgagcctggaggcagaggttgcagtgagcagaggttgtgccattgaactccagccaggtgacagaatgacactccacctcaaaaaaaaagaaagaaagaaaaggcaacctatagaagggaaaaaaaggtaaatctgatcaggggttaatatccaaaatatacaagaacctcatactactgaataccaaaaaaacaacccccaaaagaaaaaaaaatttaatgggcgaaagacctgaatagacattttttcaaagaatacattaaaaatggtcaacaagtatatgaaaaagtgctcgacatcactaatcagcagagaaatgcaaatcaaaaccacaatgattttgattacctcacatctgctaggatggctaattaaaaaaaaaaaaaaaaaaaaaacaagagataagtgttggcaaggatgtggagaaaagggaaccttgtacgctgttggtgggaatacaaattggtacagccactatggaaaacattatggagcttctttaaaaaaatgttttcaaaaattttttaaatagaataccataggatttggcaatcctacttctgggtataatacatctgaaagaattgaaatcaggatttctaagtgatatctgtactcccatgttcactgcagcattattcacaatagccaagacttagaaacaacctcaatgtccactgacaatgaatgaatgaagaaaatgtggtctatacatacaatgaaaaagtattcagccttaaaaaagaaataaatcctgccacctgtgacaatacagataggtggaagatattatactaagttaaataagccagacacataaagaaaaatactatgtgatctcccatatatttaatatatagaatctaaaatgtcaaactctccaagcatggtggccactcctgtagccccagctactcaagaggctgaggcgcgacaattgcttgagcctatgacttcaaggctgcagtgagctatgatcacgtcactgcactccagcccgggcagcggagtaagatcttgtttctaaaagaaaaaattttaatttaaaaaaaagtaactcaaactcccagaagcagagagcagaatgatggttgccagggactgggaggagggggaaatgggaaggtcatagttaaagagaacaagtttcagttatgcaaaataaataagttctgaaaagctattatacagtatagtgtctatagctaataatactgtattatatactgaaaatctgctaagaagatagatccagtgttaattgttcttaccacacacacacaaaaatgcaataataataaaacaggcaggataaaaccttgggaggtgatggatacatttatggccttgatggtggcgatggtttcatgggtgaataattatccccaaattcatcaagatgtatacattaaatatgtacagactttttatctgtcaataatacctcccataaagtagtttttttaaaaataaattgttaagtaggggaaggaaagaatgaacaaacaaacgtaggaacaaatgaacaaactcaggtaagaaagaggagatgaaaatggtatacttgtggcaggggtggatggagcaatgagctaaattctctacttctgtaataaagtatcaatagataatgactaaaactgaaaaactgaccacagaaatataaatgtgtcatttagagactagatgtataaactactgcaagacttcagtggttaactctggagagcaggaaatgggctgggggagaggcgtctactggttttttgtaacagcccttgtaaaacaacgtccacgtataactttggtaaatttggcagggcacgatggctcatacttgtaatcccagaactttgggaggcagaggcgggcaggtcacttgaggccaggagttcgagaccagcctgtttgtctccataataaatggctcctgactgctgtatttatttcgtgtcttttgttaatttatatttccttctccctcccctcacctttgctgtcaggcagctatccctcaccacagtaatcagtgtgccttcctgggacaacccctaccccttccgatgcactgtttttaattgacaaggcacctggaaaccaaataaccaagcttattagaactgtgtgtaaaatgaagaaaaatgggcaccaaaaaatgttctgaaagttgctctgtgatgcaggttggcaattttcaatacattaaccatttgtccaactcagaaccgtttggccttactatcaactatgggtcagtaggctgggtgacactcagtgggaccaaccatcccagtttagtggggactgagttatagcactgaaagtcatgcatcccgggaaaccatatcccagcattgggcaagttacttcatcttcttcaacctgtttcatcatctgtaaaatgaaagataatatctgctttgaaagattgttgaggattaaatgagaaaatgtttgtataactcttgacacatatggtagctgtagctattatactcacttgcatattgttattatcaaccctagtatcaggtagaaaaagaaagtattcttagaaacataacctgtaatttgctttatatatagtggacttcaggaagctgcaatgtttgcttttgtgaatttccttcccattttgtaacacacattttgtttcagggactaaaacatattaaagaaatttaatagttcaacatttctgatttctctactggacaaaagcctggcaggtttccactatattttcatagaaatgactcttttacactatgggagccctggggtatttatgtcagtagccgcttctaaacttgtgaacagaaatcagcctgccacctcacaaagaagaggcatcatatctgaaatttgtttttaatttccatttcacttttttccttcataatagcaccagattattcagtcttctaatcattattattttttttttttttttttgagagggagtctcactctgccacccaggctggagtgcagtggcacgatctcagctcactgcaagctccacctcctgggttcacgccattcgcctgcctcagcctcccaagtagctgggactataggcgcccgccaccacgtctggctaattttttgtatttttagtagagacagggtttcaccatgttagccaggatggtctcgatctcctgacctcgtgatctgcccgcctcagcctcccaaagtgctgggattacaggcgtgagccaccgcacctggcccagtcttctaattatttagtgaattcagtacgttgacatggggctgaaaaatctgcatttctaagttctaagttctaagccaagtcattcactaattatgtcaattctatccctgaaaaataagggcttgtatcaccaaacggatgaaataccatttctgaactcaaaagctgaagcaactccctactccacatttattaattacagcctgaaggaaattgctcacatctatgcaccccacagacaaaagggcacagttgctaaaagaacagttccaaactttgggatagataatggaaagaatcacaagttactcaaagccaaaatatggcctaggaaccctctaagaagcagtagagacagcagaaagagccaggcagataagactcttaataaaggcccccatggcctgtcctcccatactcttctatttcttctccacccagtgtccgaggcctgtgaccacaaaacacaggacaacacagaacctcagagaagccttgaggggcaactggtcaaccaattagggcaggtgaaaatggatccaggactggcagcagaatcacctaggatatgtgatgaaaatccaaaattctgggtcccattcaggcctctgaattaggatctctgcaagggaggcctagggaatctgcatttatatcaagcttcccaggggctttctggttatacacaatcaagtttgtaagccactgttctagggagacaacagatggcaaaaatgtacaactacagttaggcaaatagcctgtacatcaagatcatatttaacttctactagcctcagataccaaatctgtaaaatagggataataatactgacctagcaaggtggttgtgagaatcaaatgaaataagtaatagcctcacacacagtgtctcacatacagcaggtgctcaataaaagtccattccctcgcttgtgtatggcattctaatgaagacttacaacaatagtttttgaataaatgtcacctgttttgaataaatatcaccaaggaaagcagatggccaggaaagttaaggcctcaatgttaatgactcatcaactacaaaggccgaggtcagcagccttaaccagcgattgagtcatgaaatgtacttgtagacagtggttctcaagcttcggggtgcatcagagtcacctagatggttttaaaacacagactctaggccccaccagagtttcagattcagtaggtctggagtggggctgaaaatctgcatttctatgttcccaggtggtgctgatgttactggtcctaatctgacactttgcaataaaaaaagaaaaactatgctgtgtatatttcctgtttgacactagactggttagtttcatgtaaatagagaaaaaaactaagaaaccaacaatttccgaggctgtgctgcctctgtccctgagaatcttactatgttgtttgaacaatgcatagagaggacagggagatttgagttctatcttcccactcacttgctgtgtgactctgcatgagacatatgatctcttccagcctgagtttactcaggctgggagtaaaggtgagctagacactggttcccaaaccaggttgtccaccaacaatcactagagcagtatttaaaataaaacatagattcccaagccctagccacaaacctaataaattagaatcaccaaaggagagactgaaaaatgtgttgttgtttcttgtgggtatggtttatatatatatatatatatatatactttaagttctagggtacatgtgcacaatgtgcaggcttgatacataggtatacaggtgccatgttggtttgctgcacccatcaactcataatttacattaggtatttctcctaatgctatccctcccccagtccccaccccctgagaggccccggtgtgtgatgttccccttcctgtatccaagtgatctcattgttcagttcccacctatgagtcagaacatgtggtgtttggttttctgtccttgagatagtttgctgagaatgatggtttccagcttcatccatgtccttgcaaaggacatgaactcatccttttttatggctgcatagtattccatggtgtatatgtgccacattttcttaatccagtctatcattgatggacatttgtgttagttccaagtctttgctattgtgaatagtgctgcaataaacatacgtgtgcatgtgtctctatagtagcatgatttataatcctttgggcatatacccagtaatgggattgctgggtcaaatggtaattctagttctagatccttgaggaatcgccacactgtcttccacaatggttgaatcaatttacactcttttgtgagcatgttttaaacaaaagctccctgtgccattttcatgtatagccagttttgaggaagcattaacatggtaatctttctccagcattaaagctcttgggtctttttgatttccaattcactgggtcctgagtctatacttagccagtataagtagccttctccttttatatttgcttcacctggctattcttccgaaaggaagcatacactgtcctcaaaaaaaggaatctactctgcttagcagttccatttctcatatatcaataaactggcattctggtttcatttaaaaaataaagtccaggataggcacagtggttcatgcctgtaatctcagcactttgggaggccaaggcaggcagatcacttgaggtcaggagttcgagaccagcctggccaacatagtaaaaccccatctctattaaaaatacaaaaattagcccagcatggtgacatgctcctgtggtcctagttacttaggaggctgaagcaggaggatccacttgagcccaggatgttgaggttgcagtgagctgggtgacaaagacaagaaagaagggaagggaaggaagaagagaaaggaagggaaggaagggagaagggaagggggaatggaagggaggaaggaaggtaggaaaggaaaagagaaggaaaaaaaaagaaaccagaggcccttacagaccacaggtacatatttggatcttatacctattacaatgaaagcaactaagggattttaagcagaaggatatgaattgaattcctttaattttttaaaattttgtctcatgctcctcaagagtgtgagttccttttttgggacatcactggctttgtgtgaagaatgggctatggcagggaggggcaagaattggaacagaaaagtagcagtacaggcctttaaccagcagctggcacagagcaggcacttggatatttctgcactgctttaacatagggaaatcataatatacttgtttcacctcctaatgtatttcagaggagttcaaggaagagactctgggtgttagcaaagttccatctagatgtcacttcttttgaacaacacatagaattttggattgtccacagtacaactggttccaatcaagaagtattagaataagaacataaaaagaacacaccaggaaaccatcagaccaggcttctggaaccatccctgccatcaattagctatgtgacctgaggcacagctctggatttctgggaggggagcctgggctacaatttccaaggtccctactagctcttaaattacacaattctgtaagtgtaacaaatgtggtttccttatctgggtggcaaaatgggatgatgactcagggtgaggttttttgttacagattttcaacctcccagagaagctctagtgaagctagaatcagggtgttaataaagaaactgtccagttttattatttcctttccagggtatggtggtcagctggaaatctgggaagtagacattcctggcagctgcgagcttatcgtgcaaagactgagaacccaagtccctgtgtaacccttcaggtacacgatctctggggtcccctgctcatgtggctttcgctcatgtggaagcacacaatagacaggcactgaagaccagcctctcacttcctcctgctggtaggctgttcccaaagggtccactcctctcctatggccaacctggcacctccacgagaaccccatttcgcatgatccctgggggcagtggttctcagtctcaactgcaactgcccatcagaatcccgtgtggagacaataaataaataaataaacaaacaaacagcctgagccctaccccacatttactgacttagaattggggtgagggagaggttagaaagacaacagcggtagttaggcttagttagttttacatgatggacagaacgtgtaacttgggaaactgtaagccaaagaggttgaatgagttgtctaatgcagggtttcttagcgtcggcactgttgacattttaggcaggataatcctttgttgggggctctcctgtgtactgagaatgttttgcagcatccctggcccccacccactaaatgccaggagtaactccccagctgtgacagtcaaaaatgtctccaggcattgctaaatgtcccatgtggggtggggcaggggagaaaatcacccccaactgacatacactggtgtgatatcacatagttaataatcaggaatatggagactaaaaaccgaccgactgattcctgactgtgttgattcttccacattcaagcaggaagtccggaacacaggaatgagccgccacctgaggaaataccacaacccacttcactacacaacccacttcaatacacagcctagggcagacgtgggacctgggacagctgaccttgtccctaatgagaaaagccacattaggtctccagtatttgactgtgaggacaatgacttatcttttcaaggactgttacacctcttcactcattcttggagttgtttccttgaaatgatgcgatttattatgaaaatcactattttcataatgatttcttagcaagaaacaaagaaatcctgaccacaatcataggttatattttaaaattctttagttttgtaaatgaacatttaagtcatgacctatttctgtatgtttcatttctccccttattagggctagtacagcaagaacaaaagtatcatattattgtgtttaactagctgatttagaccttgactttgcttttaacgatacaaatacacagcagattagtatttagccataccctgataggacttgaccagcctcccaggtggtgggatcaggccaaggtagataaactatagcaaataagaatgaacagacttttcagtctcgtggcaaccaattttattattatgctttgacctggcagctggtaagactttatatgaattaaccaatgaaactatgaaaaaacaagattagtggttctgaaatatggtattcaaatagcagttagagaaagcagttcattttcaaggctgctttcttttaaataggtacaaataattacaataaaaaataataaaatcttgtttaaaaagaacagatctctagtgagcaagtcacatacacctgtctatctaccttggtccttgtcatatgtatatcttccatatttattgtaccaaaataaaaaggggtgaggaattttgtgggaataggccactcaaagcaagcaggctttccataagacaacacttagttgttgtggaattatactcagtaagaccaccttaatcaaagcaccttataataaatactccagagggtcaaaagtgttaacaaaaccataaaaaaaaataaaaccacattgaattacaggctttctggcataacagcagggacaagaaccacatggggctttcaacagttatgcggctctcagagaaaagtcaaagtgtctcatgagaatggctttggctgccacatgttggatctggggactgaaggacagtatgataatgaggtgatcttgagtggatggctagagatgtgattaaaggtcaacatgaaaacataagcaacttcttcatgacctcttaagggaagggattatgcagcagaacaactgctggttccagagtcccacttccagctctgccactaactctatgtgactttgacaaagtgacttaacctctctggagtaaattccattaactataaaagactagagtaaaatgaaatgttctctaacttccttctaattctaatactccttgggtttacaaatcttctcttttggatacatgcacaatcaccaaaaatcagccatggctcaatcattctttggacattttcaccatcgatgcatttcctatgcataaacataaactccagctagggctgccagacacaaaacaagacatccagttaaatgtgcattttggataaagaacaattttttagtaaaagtatgtcccaaataatgtataagatataggaaacaattatttagtgtttttctgcaatgcaaatttaacttttttttagtttgctaaatctggcaccccacctccatccccacattagaatcaaaactctcactccacacacgggaggttggctgactaaagcactacatggtaaacttctgtttaagggcaacatatacagacgaaaaacaaacaaccaaaaaaaaaaaaaaaacaggaaaggaggaacaaaactttcagcattcctcgtaagagaggcatctaattttacttgacaataaataaaatatgagtattactagacctcaatcatacaagtacctgcaaaaccagagagtccaaacagagctgaatgctctctactccacacaccttaccctacgaacataagtaaattacaaaccctttatctctgcctccagttcagggctcatgtctgcacctagcttaagggaaaccaaatcataaactcaaacttcctgaccaagaggcagaagaacaaatacagtccaagaaaatctgcaagtggcataaaaagtgaaggctatagaagggaaaaattactctcttcaagaaccaatcttgttttagcgatggcaagacaatttcccttctcaggggcctggccaacatggtgaaaccccgtttctattgaataaataaataagaaatgaatttccattttctcaaatttccaaaaaacttcactcttcttaaattagcacaagaggccaacaccctggagataggcactgaatggccctgcccagtttgcccaggatatagacagagggctccggtctgccactgtgggagggaccaaaatcctcacctttctacttatttgacctttccctttttaaggaagataagactattatttttgggaaagtaggacagaagacgagagacttaggagatgttggtgtatctatagacattgcttctcttagaaaaaaatggatggaatagtgggaaagaaatagcagaacactctacagacataccatcctggatgtgcccgatctcctctgatcttggaagccaagcagggttgggcctggttagtacttggatgggagaaatggcagaatgatccctattgctctgtcttctgttccctttttcattagttcaacacatatctctttgagtgcttaatatatgtcagaaaccattctatgtgctatggacatcacagtgaacaaggcagattactggccatcctggagcttgtcttctaccagtgaaagacaaatgttgtgtgtgtgtgctggtctgtgtatgacagttctataaatactcgaaagaaaacaaggcaaggtaagggggcagaaaatgatgggataggtgagggatactattctagatggagtggtctaagaaggcctctccagaaaaatgacttttcacctgaatgaaataaataagaaagccatgcagacatctgaggggaagagcattccaggcagaggaaacaagtgcaaaggtcctgaggtatggctggagcagagtcagcaaaggcaagagtgatagcagatgaagccgcactccatgcaagggttgtatagaccatggtgaggactctgtcacttctgagataaaaagccactggagagtttcaagcagagtgacataatagactctggctgctgtgttaagaatagagtgtggagcagtaagggtggaagcagggaagcccttcagaaggcttttgcagtaatccaggtgacagagatgatagaacttggtggaagcagcagaagtggtgagaaatggttatcatcctagatgtattctttttttttttttttttttttttttgagacggactcacactctgtcgcccaggctggagtgcaatggcacgatcttagctcactgcaacctccgcctcctgggttcaagcgattctcctgcctcagcctcctgagtagctgtgattacaggcacccaccaccacgccccgctaatttttgtatttttagtagatacagggcttcaccatgttggccagcctggtcttgaactcctgacctcacgtgatccacctgtctcggcctcccaaagtgctgcgattacaggcgtgagccaccgcacccggcctgctgaggaatttaatgtggggtataagagaaagaatcaagagtgatttcagggtgtttggtgtgagcatctggaagagtgaagttgccattcactaagatggagaagactaggggaaaagcagctttgggagagaaaactcaaaaatctggctcctagagattgttgctcactttaaaacccttacatctattttagaaccaaaacaatagaaattgagaagctgactttaaatttcatgtggaaggccaggcatggtggctcatgcctatgatcacagcactttgggaggctgaggcagacagatcacctgagatcgggagtccgagaccagcctgaccaacatggagaaaccctgtctctactaaaaatataaaattagccaggcatggtggcacatgcccgtaatcccagctactcaggaggatgaggcaggagaatcacttgaaccagggaggcggaggttgcagtgagctgagatcgtgccattgcactccagcctggtaaataagagcaaaactccatctcgaaaaaaaaaaaaaattcatatggaaattcaagggactggatagtcaaaacaatcttgaaaaagaacaaggttggaggactcacatatcctgatttcaaaacactatgtagctacaataatcaaggtagtatgatactagcctgaggacagacatacagatcaatggaatagaactgacagtccagaaataaacctttacattcatggtcaatttatctcaacagaggtgccaaaactattcaaagaggaacagtcttttaaacaaatggtgctgaaagaactggatatccacatgcaaaaagttgaagtcagaccccctgcctcacaccatatttaaaaattaacttaaaatgggtcaaagaatgaaatgtaagagctaaaaactataaaacttttagaagaaaacataagtataaatcttcatgatcttgaatttgacaatgttttcttaactttgacatcaaaagcacaaacaacaaaaggaaaaataggctcggtgcagtggctcaagcctataatcccagcactttgggaggctgacgcaggttgatcacttgaggtcaggagttcaagaccagcctggccaacatagcaaaaccccgcctctactaaaaatacaaaaattagccaagcatggtagcacacacctgtaattccagctactctggagtctgaagcaaaagaatcacttcaacccaggaagcggaggttgctgtgagccaagatcatgccaccgcattcctacctgggcgacagagtgagactctgtctcaaaagaaaaaaaaggaaaaatagattaaatatacttcaacgaaattaaaaatcaaggcacgtcacagaaattaaggaaggaagaaaaaagggagggagggaggaagagagaatggtagaaaggaaggaagaaaaaagtaggaatgaaaacataaaacaacataaaccaacataaaatacagaaaataatgatcctcagtcaagttccttcagcattatattaacctttcttcacttctaaccatctgcagaaactgttttccagattgtattttccctctaaagcaagtttttaaggccgaaaaaaaaaaaagaacaagaacagtgagtggagaatcaacaaatttaattagcaatgattacagaaaacttaaatagcacacacaactctataatccctctacccccaattccaacatctgactgatcaaccaaccataaaatgtgagaatccatccagaaggaaagaacagctgttaagctgtaggggtaaggaccctgtggcagaagaccctgaggccatgtgggcccaggtggccagcaggagcggaaaggctgggaaggctcctcagtccagggctcacaagactcccttcgcttcaggcctgactttgctgaactggtgatctattgggacagagacaggctttggcaatagttaccaaagcctgtcatcatatctgcaccaccaccagtcccgaccggagggcctggctgccaggtagttttcagtctaactgacaggagaagagagagcccctccctcgcagctagtctgcagtccagaccctcaccaaccggagggcaaccaggttaaacagttaaactgaaagcaaaagagggaggaatgaaccggggggcgtgcgggaggtcggggactttcctcctttccctcctggaaagtttcctacccctgatgggcatcctcccacctggatgcaacccggaggcgatctgagaccctggccggacctgggaccgcacctggccagcaccaggcagttgtcatcactggggtctgcgctgagggcctgggagagaagccactcttcaggcgggctcgggcgcctggaggcggggaggaagggcggcgcactcggaccccagccctaggacggccccagggggacgcctcgctcggccctcccggagggaccggacccgccgcgcgcctcccgctcctcaggccccctcacctggctcgccccgccgtcctgtccccgcctggctcgggtcctcgcgcgccgcgtccacccgccgccggccttttttgggtcgttggcgggtattttccgc

SEQ ID NO: 1931 - DNA, 67943 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatcgctgtaaaaacccacaatccagctaattagtctcagctgtttgtcatatggcactgcagaccagtcaagtgatttttgcccctttcaagcttaccaagttccagttcgactggccactcagagggcggctttattaacctcttctggtgttagaagactctgcacttcagctctttcttccgcccacctaccccgtgaatcaaaacagtagaacatttgttttcttgagaaagtgccttgtattctcaaggcccttaaaggttatattcatattgttgcttacaaatacaatgcctgatccaaacaaacaatatgggggatcaaatggaagtggcaggagggatggggctagattacttaccagaccttgcagctggcctccaatttcataagtaaaactgcctacaagggagtccacccagatatcttgctggcatctcaaatccagcatgtcccgtactcacctcctttgcttttctccacaaccttgcttcaaacccacttctcttcctgtg

SEQ ID NO: 1932 - DNA, 67428 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatc

SEQ ID NO: 1933 - DNA, 67320 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtct

SEQ ID NO: 1934 - DNA, 88663 bp, Homo sapiens
acttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcggtaagcagcgggcccagcccggccggcggcctggccccatcccccccctcagcccctcggtcgccagggcctcgcgtcctccctgtcctcctgggcaggctccagtcccagccctggccacgcgggcacacccggcatcgctcaggcccccggagcaggccaagaccccacccggcttggagaggtcggaggtcgtcgggcgtgacctctggccgggttgcccgccccggccacccgtctcggacgctctgtttactgttggcctggatctcagagacccgagagggttccttgacttgggcggccctgcgccgcggcaggacgcgctggccagtggagttccttagcgcggcgagcaggagggtgtcagagcccacgccgcccgccgccgtgcccacccggcgggcatgggtcacaggcgctgggggccgagccgcgttcccatccggttcttcagttgaacagcctgaccctgttagtgggagttccctgacggcaactgagtcaaggcagtgagtcaggtcacgtgcgctgggctcgcctcgacacttgtgtacattgaggcgcctctggcgctgggagacagggagctttttgtcctaggcatgttacggtaaatcctgagagaagtttttcaacttaatcgaggaaagatggtagttggatgtagagttgtgtttccattccgaccgtgtttggggcctctttctgcattcattttaggcttgatacctaatggggtcataaggggaatattgagaatattgacagcaaatatttgagcgtttattgtatgctaggcagcgtggcaagaccttttaacagatcattatgtttagttctttgaacaaccctctgaagtaccactgttgtgcccacttaacacagtgggaagttgaacagagaggctaagccatttggccaaggtcacacagctaataagttacgaagcagagatgcaagcccaggcagtcagactccagagcactgtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggagctcttgaataccggcagggtacttaactgaggtttgaaaaattttgcaggtaggcctggcaaacctgcctagtgaacctttcttacaaccttagttgatggctgtccagccggctggttcttccctattcaaaatactgcatctttggtttcctaaagaacggactcttgtctctttcttgtgacttaagcagctgatgaagcacatgatttctcatccatggatgaataaagtctcctcttagtgtgtttctctcttcaaacttgggaaggtttgttcagatttgagtttaaggactggaaggtgagttaggagtacttcttctgaagaagggaccggctaagttaaagcttagcgttcacaatcctgttgtattcatatttgtcttttttttttttaactttgctacctagcctaaaatatttaagtgagtaataagtactgtggctttatataatgtttgagtttagagtaatgataggcacctttttattcattcattaagtattttgagtatccattgagtatcagcaatgtatcaggcattgtgggacattgactcagggagataggcgtggttcctgtcctcaaggaatttttaaaaggtgaatgatcttggccagaaattctgttgtggaataatttggcggtagaacttgaggctttttggaaagagttatttctcatctctgctggtgaatcagtagtaacccaaaggatggtgttcttctggctaactttaaggctttgttaattttaacaacagcatttgtatggtttgctcttcagagagtgtagaagataatattacagtttctaattaatcacatcttttaaagagtaaccttcaacactcaacttgtttctccttttgctctagtggcatttattttattttatttatattttgagacggagtttccctcttgttgcccaggctagagtgcaatagcgcgatgtcggctcactgcaacctctgcctcccgggttcaagccattctcctgcctcagcctcccgagtggctggaattacaggcatgcgccaccatgcccagctaatcttgtatttttagtagagacaggttttctccatgttggtcaggctggtctcgaactgcctacctcaggtgatccgcctgtctcggcctccgaaaagtgctgggattacaggcatgagccactgcgcccggccgactctggtagcatttttttgttcactcaagaggtagtccatgtcactactgtaattaccttgcactgccatgtctttgagcaaaggtacatttggcatgctggatttttttcttcagctggcaagaaagtttaatgtagcactgatagtgtactggccatagtttcagtaccattctacatagaaaagctgtgttaccctatctcccacaactttctagattcccttctttaagggaagatttggattttacatttgtggtagaactgcataagtaaacagagggtggaatgtagaagatagtctaaaaatagttttattagtatatccttctaggtagttagcaaccacttggggcaattttttttaaaatttttttttagtgccaactgtgtctaagctcaccaaccctgtaatcagagaacaactctttatagtaaagtgtggctttgaatcagttttctgaccccactgccaagtgaagccaaaaaattttggttatttgattagcttttaatatgtcttcagctgggcacggtggctcacgcctgtaatcccagcactttgggaggccgaggcaggtggatcatgaggtcaggagatcgagaccatcctggctaacacagtgaaaccccatctctactaaaaatacaaaaaattagccgggcgtggtggcgggcgcctgtagtcccagctactcgtgaggctgaggcaggagaatggcgtgaacccaggaggcagggcttgcagtgagcagagatcatgccgctgcactccagcctgggcgacagagcgagacttcttctcaaaaaaaaaaaaaaaaaaagtcttcaaagggatcttcactaataacgtttttgctcttactttggcattagactttgtaaacaaagatgtagcaaacacagaccacgcaaatatgacagttgtcttatgcacattcctctctggcatttgacacaaatattttagtttttcctatgataaagtatttatctccccattcatttaattcaacaaatacagctgagatagatttgaccagatgttggacttggagctgtaggcaggcttttcctggggaggtaaggattagaagtcctcctgaataaggctaaacagaggttccccttggcattaaatgtcttcttctgaaggcgactgaaactcgagaaatgaactccccgcctccccccttattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatcttgctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtggtggtcactgcgatttgtgaatcagaggtaaaagtgatgtggcgagtgaaatcaaaacaagttttttagcagtgtctgttaccagtttcaattttagtatcccaggctgtgattacaaaaacatatttaagaatagctacttgcaaaatatctccttgtgggaggaagaaagcttgggagttggttccaatgctgacctacagcattggccttgttcatttgcttgaagatgcagtacttaactcatggggcctggagtctctgttttggtgatggcatcactgctgagaaatttaagtttgcctgattctgttgtccacttctggtgtcctgggactgtctacagttgggaccaagcaaatccaagggagcctatttaaggggagcctgggacaagggcagtttaggaattctccagccttgcttgtctcttagttggtccttcttgtgtggctgctgccagataaaggaaaggaagttctctcttctccctcagcctttcctttccagctttgcttcatactgctgggcattaaccatctcagatcaggagtcctttaaaagttacttagtgaagtaaatagttacatcattgatttccaatattggtatgtaagtgtaataaaaagttggtttccattgaataagctttgtagtttgagttatttgagagtgcataattacaaagctgctatgaattaaccttaaataaccaagcatagactttatgaaaaatagtgtcccttatatgtggtattcagtcagcctaccaacagttcttctgttcacttacagatatgaggatccctgagataactgcgggtcatttaaaacccactcttaaatcctctgacctgcaccatgttaatggttgttaaaaaagcgataacattttgtagaaaccttcctacacatttgcctttaaatgctttttaatgtttctgtggtatttgtagtttacatgtgatttcatttggtgctcacaactgttgtgtgtatctgcctgaaatagctgaggctgtatgctcaggtggctcagctggaatgtcagtctaggtctgctaactcagttcagtgctctttctgatgtaccatcctgcctttccattatatgctagtgccctaaagaccacgacatttcaccccttgtaaaagtgtatctttcggccgggggcgatggctcacacctgtaatcccagcactttgggaggccgaggagggtggatcacagggtcaagagatagagaccatcctggccaacgtggtgaaaccccgtctatactaaaaatataaaaattagctgggcatagtggcatgcactgtagtcccagctattcaggaggctgaggtagtagaatcgcttgaactggggaggcggagcttgcagtgagccgggatcgtgccattgcactccagcctggcgacagagcaagattccatctcaaaaaaaaaaaaaagtgtctctttcttccactaccttttttttttttctctctctgagacagagtcaagctctgtcgccaggctggagtgcagtagcatgatctcggctcactgcaacctccgcctctcgggttcaagcaattctcctgcctcagcctcctgagtagctggggctacaggtgcacgtcaccatgcccagctaatttttgtatttttagtatagatggggtttcaccatgttggccaggatggtctcaatcccttgaccctgtgatccgcccgccttggcctcccaaggtgctgggattacaggcgtgaaccaccacgcctggcccactaccttttatttaaaatgatacgtcttttttgctgattattaaactattcagttaaaaaaaaaaagctaggaaaattcagaaatataaagaaggaaaatttgtgattcactaccccgaggaagaccaaagtgttaactggttattttcttcctttgaatgtatactttcataccttcctttaatgagattgaactcttggccaggcatggtggtcagtactttgggaggagtaatcccagcactttgggagggtaaggcaggaggattgcttgagcccaggagttcaagaccaccttcagcaacaaagtaagactccatctctacaaagaaaagaaaaaattaggtgggtgtggtggtacacttgtggttccagatggtgggaggctgagacgggaggatcacttgattccaggagtttaaggctgcagtggtttgtgttcgtggcactgcactccagcctgggtggcagagcaagaccctgtctcaagaaaaaagaaattgaactctccccaaaaatgatgtgagaatttaactgtggaggagaccagatactcttgggtgatgtgacctgtgatacttctcctagtagacactgaatgatgagaagctggggatcataggaatagctgtatttttcaaatgtttgttggtaacgagtgaggaacctgatgcatccagctccagagtaaggtttatttgccatggtaacactggataagtacattgttgcctgtatttccaagtaatttatcatttctgtattttagtaaacatacatatatacagaaaagtgcacaaataagtggacggcttagagaatttttataaacccagaggccctcttagtctcctttaagtcattatcatcgatgccctgatgcttgcgtagtgagtcttctgatttctagaactgtagactaattttgcctgatttggattttgtgtaaatggaatcatacactgtgtattcttgcgtatctggtttctttgactcagtgttgtttgtgagactttgtgttgttgtgtacagttgtaactggagtttccattgctcagtagtattatgtgatatatcataatgtatttaagtaaaaagactgagttttagggtatgtgtctgtattcatttgctagggctgccgtaacaagtatcacagatagagtggcttaaacagaaatttattttctcaattctgaaggttagaaatctgaggtcaagctgtcgggaggattagtttcttctgaagcctctccttggtttgtaaatgactgtcttctcttccctgtatcttcacaggatctttcctctgtattggctgtgtcctattctccttttcttttaggacaccagtcgtattggattgaggcccacccttatgacctcacttaacctcagttacttctttaaaggccctgtctgcaaataagtcacattctgatatattggggattagaatttcaacttaaaaattttaggtggacacagttcacttcataagagtatctattctgctctagtagatatggccagttttcaaaagttgtaccagcgtattcttccaccagcagtatataagaagtccaaatattccacatccttgctagcacttgtaactttttctctctaattttagttccctctggtagaaagccatttctttatggcaccatggtacagcttgtttactcaccagtgtaggggaacctcaagggactggggaaggttatcctggagtaaaacgtgtcagtttgagactacctcttgtaaatgctacttaaatccattggggttaaaagcagaggttcggccaggcacagtggctcatgcctgtaatcccagcactttgggagaccgaggtgggcggatcacttgaggccaggagttcaagaccagcctggccaacatagcgaaaccctgtgtctactgaaaatacaaaaaattagccaggcgtggtggtgggcacttgtaattccagctacttgggaggctgagacatgacaatcgctcgaacctgggaggtggatgttgcatgagaatcgcttgaacctgggaggtggagctgagatttcaccactgcactctagcctgggcgacagaatgagaccctacctcaaaaaaaaaaaaaaaaaaaaaaaggaaagaaaagaaagaaaggaaaacaccgcttcagtccagtgaatgagcagttagtcttccatagttgcccatagcttacttttatagtctggactccattcctggtggtggaattggcctgtgaaagagtaatctgtggggtgtagatctaaccatagtagatggtgctttcattccaactctcttttttggtcagacacttgagcccttagaatatcacattctatcgtacatatgctagaaataggtctgttttgcatattctgactgacccttcagatattagtgggcctttcaccaccagccttttggctgcgtgatcttcagctttgtgtatccattatagaccttagtttgattgaaataatattacatgactttgcctgtcttccaactctaagccacttgaggacaaggatgaatcattattctagaatggatcttgaaatattactaagcttttgtttaaattttttccagttctagcttttcagagtaagttaccgtttatagcatgtaagttatgcttctgggtcagtggttaatatatgtgggtttcctgaatgatgaactatgtgttctgtgttcatttaacaggtttttcttctctactataagaaaacactgttggcccctgtggagaattattcaggaataattgtaaatacagggcagatgagagttacttagtttagagttgttcaatgcctggggtggtgaggggcatgttgagtggatttttaaataaattggtaggcaggtgagagttgggaaaccattatagttggaaagaatggcataagtcaatgaatggatgtagggattgcagtagctctaatttgggaatgactgtatgtatggaaaccagatcctggtagggagggcaggcactgcaatcccttgttagaggatttaagttcaaccaagtggcacttcactctgtaatgctggaatagacacagcataatcctgtcacttgaacctcacaattaagtcagatagtaccccagttatgggtgaggaatggctttgatgttgtaatttgtctaaagaaaccatacattaagagcttagtgggctaggattgaaatactacaagagttgtgcttaaactttcagagagttgcttcttcagaagtggctttaatgaaaagttaaacatgggagctggttaggggaggtgggatagaggaagagagcagttagtttggttttcctctttagccagcccattgtgggctcctcttagcaatttatgggcagtctgttttactggttaaatgcctgagataatctagggttgatatcaaactatcgaagatagttcttatgtaactgttttactagctatctgctttccagtttgccttaccaaaaagaaaaaaaggcaggaatcatcctggtctctcgttagagactaaacttttggcttagtacctgggttcagaaagcttgatgacagtggtgcatcgtattgaagaatctattgatccaggagtgaagtcctcttcacaagaattgccttccaagacactcttctttgtgtaagttgcctttgccttttccctcccagcaggaatgcagtactcagagcaaagtacataaacaatgtctttacatttcatagaggttgttaccttgtttaaacttcacaatttaagcagcatttgatttgtctctttttttttttttagatgaggaaatggactaaaaggtcatgctcagtatcttggagccactgtgtgttagtgggactgggactagcatccagtattccaagttgacagataattctttaataatggcagaagaataatagcatcttctgcggaagaacagcctttgtacattttatcattcagttttatttaaatgtttttaaaagagggatttcagactagtctgtttcttttgaaacatagattttcaggtggtgaatcttcaagcactatcagacagaataagctaggttatgctgtagtaaccaataacctcaaagtggtcaaaaagagcatgggttttctagaggctctgcatcattcttactccaaccaaaggagcagccgtgataggagtattgatggctgtcttggcaaagggaaaaagaactgttggaggcagttaaattccagcacgtacagtttaaatccagcacatacagataaatttaaatactgttaaataaagttatttaacagtatttaaatttaaaaaaatttaaatacagttgaatacagttaaattccagcacaggaatgacacattatttcatgtcacttctgcttagggttcattggccaaaatgagtcacaccacacaaggaatcaagtgtgatcctacatgtgtggacttggaaggcacggagttggaaatatttgggaaatagcactagtatcatacttggcttataatatgtaatagctattgggggaaatagctctcatttgcagaatctctttctacaaatcagctggtaatttaaatgctaaaaagagcttagttatagatactgtgttgcccgtctttactcactaatcaccttccgatcctaagaaatttatttatttattattttttgagatgaagtctccctctgtcacccaggctggagtgcagtggcgcgatcttggctcactgcaagctccaccttccgggttcacgcccttctcctgcctcagcttcccgagtagctaggactacaggcgcccgccaccacacacctggctaattttttgtatatttagtagagacggggtgtcactgtgttagccaggatggtctcgatctcctgaccttgtgatccgcctccctcagcctcccaaagtgctgagattacaggcgtgagccaccgctcccggccttttttttttttttttttttgagatggagtctcgctctgtcacccaggctggagtacagtgacagtgcaaccccagctcactgcagcctctgcctcccaggctcaagcgatcctcccacctcagcctcccaagtagctgggactacaggtgtgcaccaccatgccccagctaattttttatatttttgatagagatgggatttcaccatgttgcccaggctggtctcgaactcctgagctccagcaatctgcttgcctcagcctcccaaggtgctgggattacatgtgtgagccacctatctttctgtctctcttttttttttttttgagacagggtctcactctgtcactcaggctacagtacagtggtgccatcatggctcaccgcagccacgccctccccaggcttaggtgatcctctcatctcaacttccccagtagctgggactacaggcacatgccaccacatctggctatttttttgtagttttttttttttttttttttttttttttttttaagagatagagtttcaccgtgttgcctaggcttgtctcaaactctaggcctcaagtgatcctcctattttggcctcccaaagtgctaggattacaggaatgaatcaccatgcccagctctgccctgtctttagaaaccccactccccttttttttaaggatttgttcttgtttttattttatattttaatgttttgagacaaggtctcactgttgcccaggctggagtatagtggcctgaacacagctcactgcagccttgacctcttgagctcaagtcatcctcctacctcagcctcctgagtagctgggcttacagttgtgtgccactacgcccagttaattttgtttttttgatagtgacagggtcttggccatattgcccagctggtcccaaacttctgggctcaagtagctcgcccaccctggcttcccaaggtgctaggattacagatgtgagccactactcgtcaagaaccctatgtttttccattattcttgtttgaggctctccacaaatggtctccagcttgccttcctggctttgttttttttgataaagacacatattcctctgagttgctttattcaccttttccttaccacactttgttccctacttcctttatcttgattcctgtcaattccccttcatctctgttttctagctccagtactctgttggcatcctgcctgactcaggtaccagtccacttttaaagcttttcttgaccacttacgtctatagtgttctttttactgaatccctggggcttgccacagattatcttatagttgtggattttgtatatgtatctttcctaccttaggagggggccttaagggtaagtcccagactgatttacctgtttttccccaaatgttaaccatttgaaagaaagaactaaatggatatttctcaaatggcttttgatagatacatgtacaatacatctgttgtcatacctggttggaaaaaaaaatgcctgtaaattcttcacattgtttgaaatcagtgtgtcagaagctgtaggattgtagaagctttcttaagcaaggccatagtatggctgtcaaatctgttactaagctttagtctccatttctgaaaaacgagagtaatgtgtaatccttaagatcctttcgtattttgacattctctgactcttggacatactgctgtggcttttgcaacatcctaactggttagttgacaccatcagaaactttaaggaccctgttagccattgagtatatggagctttgcccattcgtttctgagaggcaagaggcactggtaggcagttagatttttctttaaaatgtgtactcgtttctaaattacagaagcagtataaaagtcttaaagcgggccgggagtggtggctcacgcctgtaatctcagcagtttggaaggctgaggtgggcggatcacctgaggtcaggagttcaagaccaccagcctgactaacatggtgaaaccccgtctccaccaaaaatacaaaaagtagctgggtgtggtggtgcgctcctgtaatcccagctactcaggagggtaaggcaggagaattgcttgaacctgagaggcagaggttgcagtgagccaagatcgcgccactgcactccagccttgccaacagagcaagacttcatctcaaaaaaaaaaaaaagtcttaaagtgaacagtttttttctgtcattctggataatttgatggctataattcaaaacgtttattttttataaaatttaaatgagatcataaaatacatactcttctgctattagctttttaaaaatttaaccatatagtcagcttttcttataagtacatactatttttaatgactgtataatattgatcataatttaacaatcctctaaatgaacatttcagttatttccagctctttaagaaaagtatttaatagggccgggcgcagtggttcacgcctgtaatcccagcactttgggaggccaaggcgggtggatcacttgaggtcagttgaagaccagcgtgaccaacatggtaaaaccctgtctctactaaaaatacaaaattagccgggcatggtggcacatgcctgtaatcccagctacttgggaggctgaggcaggagaattgcttgaacctggtaggcagaggttgcagtgagccgagattgtgccattgcactccagcctagacaacaagagcgaaactccatctcaaaaaaaacaaaaacaaagaaaagggctgggcacggtggctcccgcctgcaatcaatcccatcactttgggaggccgccgagatgggtggatcacgaggtcaggagatcaagaccatcctgaccaacatggtgaaatcccgtctctactaaaacaaatacaacaattagctgggtgtggtggcgtgcacttgtaatcccagctactctggaggctgaggcaggagaatcgcttgaacctgggaggcagagatggccgtgagccgagatggcgccactgcactccagcctggcaacagagaaagaaaagtatttaatatttatattttcctacttatctaatcatttccttaagatttagtgagtatacatacttaaaatttggttttcattgccatatagccttcaggaaggttgtatactttacattttgtagtttgagaatttcatttatatacttgtcaattgtcagttttcttaatccttgccagtttaatgaatgggaaaaatttaaatgatgtctcattgttgagggcttgtgttttggccaggcctggtgggtcactcatgcctgtaatgccagcattttaggaggccaaggtgggaggatcggttgagcccaggagttcaagaccagcctaggcaacatggtaagaccctgtctttacaaaaagttaaaaaaaaaaaaaatagctgggtgtggtggcacatacttgtagtcacacctacttgggagattcaggggaggatcacttgagcccaggaggttgaggctacaggaagccatgataattccactgtactccagcctaggtgacagagggagatgtctcaaaaaaaaaaaaaaaaaaaaaaaaaagacttgtgtttctttgtttgatagattaaactagaaaaatactaactacttttttatattcacttaaattttgtagaaatttaagtatatataattgtataataaatgtagaaaaaatattaactacatttttttatatatacttaaaattttttttaactttcactttctgcttttgtatatttatagtcttttgtgaattggcttttgttctctaaagcccatgtgaggttcttgtacctcacctctctcccagtttataaactttatatggcaagaattttgatccttttcgtgttgcaaacattattcctggcttgtatctcttggtcttgtttggctgatggcatgtttttgtaacatagagacttttctgtagtcacatctgtcaattcattttctgtgtttcatattatgcttaggcctttcccacccccaggacaataaaaacaatgttttcttctagtaattctagcacttagccaggtataatatgtcggaatcttttcccaaatgtatagttttcccagtattttattgtattatcttttctctttgactagaaattttttttatcacacagtatatttcctacttccatgtctttttttatttttattttaaatagatttatttacgaaatagagatggtgtctcactatgttgcctaggctggtctcgaactcctgcactcaagcaatcctcccacctccacttcccaaagtgctgggattacaggcatgagccaccatgcctggctgtgtcttttgttttttaactcttctgtttcattctttgtctgtgggacagtactgctgtcttatttgcgtctgttttgttttatacgtatatacacagatacatacacgcatacatatacatacacacaaacattttttttttccttggagacagggcattgctctgtcacccaggctggagtatagtagtgcgatcatgactcatcgactcattgcagccttggcctcccaggctcaggcgatcctcccacctcagccttctgagtagctagtatgtccggaattggtgggttcttggtctcactgacttcaagaatgaagccgcagaccctagcggtgagtgttacagttcttaaagatagcgtgtccagagtttcttccttctgatgttcggacatgttcagagtttattccttctggtgggttcgtggtctcgctggcttcaggagtgaagctgcagacctccacggtgagtgttacagctcttaaggtggcacgtctggagttgttcgttcctcccgtctagagttgtttattccccccggtgggttcgtgatctcgctggcttcaggagtgaagctgcagaccttctcagtgagtgttatagctcataaaggcagtgcagacccaaagagtgagcagcagcaagatttactgcaaagagcgaaagaacaaagcttccacagtgtggaaggggacccgagcgggttgcccatgctggctcgggcagcctgcttttattcccttatctgatcccagccacatcctgctgattggcccattttacagagagctgattggtctgttttgacaggatgctgattggtgtgtttataatccctgatctagacacagagtgctgattggtgtgtttacaatcctctagctagacgtaaaagttctccaagtccccactagattagctagacacagagcactgattggtgcatttagaaaccttgagctagacacagagtgctgattggtgcgtttacaaaccttgagctagatacagagtgctgattggtgtatttacaatcctttagctagacataaaggttctccaagtccccactagattagctagacacagagtgctgattggtgtatttacaatcctctagctagacataaaagttcttcaagtccccactcgactcaggagcccagctggcttcgcctagcggatcccgtgccagggccacgggcggagctgcccagcagtcccatgctgcgcacctgcactcctcagcccttgggctgccgatgggaccaggcgctgcagagcagggggcggtgcccgtcggggaggctcgggcttcacgggagcccaccgcaggagggctcgggcatggcgggctgcaggtccagagccctgccccacggggaggcagctgaggcctggtgagaattcgaatgtggcacaggtgggctggcggtgctgggggacccggtgccccctccacatctgctggcctgggtgctaagcccctcactgccccaggccggtggcgccagccggccactccgagtgtggggccctccaagcccacacccacccggaactcccgctggtccgcgagtgccgcgcgcagccccagtttcccgcccatgcctctccctccacaactccctgcaagcagagggagccggctccagccttggccagcccagagaggggctcccacagtacagcagcaggctgaaggggtcctcaagcatggccagagcagacgccgaggccgaggaggtgctgagagcgagcaagggccaccagcatgttgtcacctctcactgggaccacaggtgtgtaccaccatgcctgactaattttttttgtagagatggggtctcagcttggacattggaattgctagccaaagacattagagcaactgtcagcaatatgctcagtggactaaaggaaccacagatgaagaactgaaggagagcagaaatacagtctctgaacaaaatcaagaaagaggctgggtgcagtggctcatgcctgtaacgccagcactttgggaggccaagatgggaggattgcttgagcctatacgttcaatatcagcctattcaacatgacaaaataatttctctctctctttttttttttttttctgagacagtctcgctctgtctcccaggctggagtgtagtggcatgatttcggctcactgcaacctccatctcctgggttcaagcgattctcctcctcagcctcccgagtagctgggtttataggcgcccaccaccacacccagctaacttgtgtatttttagtaaagacggggtttcaccatgttggccaggctggtattgaattcctgacctcagatgatccacctgccttgacctcccaaagtgttgggattacaggtgtgagccaccgcacctggccaaattcttgctcttaaaaaaaaaaaaaaattggcacatgcctgtagtccagctacttgggaggctagagtgggaggatcacttgagccctgcggttggaggctgcattgagttatggtcacatcactgcactccactgggtgacagagtgagacccagtctcaaaaagatagaaactataaaaaggaactatacagaaattctggagcataaaagtacaataactgagatgaaaactttattagaggggttcaccaatagatttgggcagacagaaaggcccatacctgggtcagccctcttagagggactgatccatttgggagacatttgaaatttattctcttagatattttgaaatatgatacattattatttgaaatatgatgcattattatcgactacattccactgtaataaaaagaaaacatcacagtggaaaggccacactccttcattatccagttgggaacctcagcagcacagccaagtgatctgctaagctgctttggggaccacacctgtgccacttgtatagctcccagcacagcctggttcacaagaattccttatcctattgtggaccttttggcccaattaacacaggcccacaggatttaaagttgccattggtccttgtgaaaagctaaccaggtaatgtcagtgtgaggtcacatacaatgtgtgtgtttctgccctgcatttggctcagagccacttgtaataattttttgctgttgaggtttccttgatacttctctgaagtcactttttctttttttctttttctttttttttttttttgagacagattctcgctctgttgcccaggctggagtttagtggtgcgatctcggctcactgcaagctctgcctcctgggttcacaccattctcctgcctcagcatcccgagtagctgggactacaggcatccgccaccacacctggctaatttttttgtatttttagtagagacagggtttcactgtgttagccaggatggtctcaatctcctgacctcatgatccacccgtctcggcctcccaaagtgctgggattataggcgtgagctgccgcgcccggctgaagtcactttttcattaaatttttctggttaacttcaagtactgcgtgtctacctgttgcctaaactagggtatgcactgccccaattctgcagggagggtgcaaaacagcaaaattagatgtgacccatctttctggagtttcagttgtactgtaaaatttggaagaaacagtagtttattaagaatcatctttttttttgttttggagacagagttttgctttgttgcccaggctggagtgcagtggcatgatctcagctcactgcagcctctgcctccctggttcaagcagttctcccaccgcagcctcctgagtagctgggattacaggtgcgcgcaccaccatgcccaactaatttttgtatttttagtagagacggggtttcgccatgttggccaggctggtctcgaattcctgacctcaagtgatccacatgcctcagcctcccaaagtgctgggattaccggcctgagccaccaggcccgggtgagcaccatcttattaagaaaagacacagaagagcagggaaggggagaagtgttccaggaaacacagtccaggctctgacattgctccaggtgggatggagggactcaccccttactttgaataggatgcttttgaaggccacaggggtgccagttgtcctcttgacttgaatcccatgcagagactttgttggcagtttgcacacatccatcctctgctggttgagtcctctgagctgagtgtgctggtcacacagcaatgtgggcttcttgaccagcgccccctggcacctatttaagtccatgcttggctgacctgccatgctgtattgtcaggatccatggagctcgggatcttgttgctttctattctaaatgcaaggagacatttgaaatagactcggatattctgaaatgtccaaatatttattattgactgtagtcaccctgctgtgcagtagattagaaagttattcctcctgtccgaaacattgtaccctttgataaacaaccctccattatttctctctcccaccaccccagcctctgttcaccatcagtctactctctacttctgtgggttcaactgtttatttttagcttttaaatttttctttgatttttagagacagagtcttgctgtgttacccaggctagagtgcagtggctcaatcatagctcactgcagccttggactcctgggttcaagtgatccttctgcctcagcctctcaatgagctgggacaataggcctacactgtcacacctgtttacttttattttttgtagagatgcggtctcactgtattgaccgggttggggttcaacatttttatttattttttttatttttttattttttattttttattttgtttttggagatggagtctcgctctgtctcccaggctggagtgcagtggcgcaatcttggctcactgcaagctccgcctcccaggttcatgccatactcctgcctcagcctcccgagtagctgggactacaggcacatgccaccacgcccagctaattttttgtattttttagtagagacggggtttcaccatgttagccagggtggtctcgatctcttaacctcgtgatccacccgccttggcctcccgaagtgctgggattacaggtgtgagccacccggcccggccggggttcaactttttaagattcaacacattggtgatatcacgtggtaattgtttttctgaggtgatagatatatgttagttagcttaacttaatcattccatattgtatacatatatctaaacatcacatggtacccataaatgtatacaattatgatttggtaattaaaaatcatattaactgaaacataataggctgggtgcggtggttcacatacctgtaatcccagcactttgggaggccgaagggcaaagatcactgaggccaggagtttaatcagcctgagcaacatagcaatactctatctctacaaaaaaataggcttgttggtgtatatctgtagccctagctacttgtgaggatcaggcaagagtattgcttgagcccagaagtttgagattacagtgagctatgatcctgccactgtactccagcctgggtgacagaacaagaccctgtctcttaaaaaataatcggccgggcgcagtggctcacgcctgtaatcccagcactttgggaggccgaggtgggcagatgacctaaggtcaggagttcaagaccagcctgaccaacatggagaaactccatctctactaaaaatacaaaattagctgggcatggtggcacatgcctgtaataccagctacttgggaggctgaggcaggagaattgcttgaacccaggaggcggaggttgcagtgagccgagatcacgccattgcactccagcctgggcaagaagagcaaaactccatgaaataatgaaatgaaatgaaataaagaaatgaaatgaaatgaaaagaaaatgaatctcagccaccccacatacttggtttatttcttggcctcagctgtccattggtgccactttatttctagctgtgtggtgggtctttgggcctgcaggaagcaaaggattctttttcattttgttttgttttgttttgttttgttttttgagacgagtctcactctgtctcccaggctagagtgcagtggtgtgatcttggctcactgcaacctccgcctcatgggctcaagcaattctcctgcctcagcctcccaagtagttgggattgcaggcacgtgccaccacgcccagctaatttttgtatttttagtagagacgaggtttcaccatgttggccaggctggttttgaactcctgacctcaaatgatccacccacctctgcctcccaaagtgctgggattacaggcatgagccactgtgcccggccagcaaagtgttcttaagatgaagtttgacaaacatcctagaggccccctactggccctggcacttgccatagggatgaggctcaggtcacatcatctggtcgctcagcatggagggatttggttcctaagattatcgttggggacaggtgactccttctgggtttcctccactgctgctggtacattgagtggagggggttatgttaatattggtctcattttcaggtcgagtaagggactggcaggcatggtggcttttctggtggtcttctgccctaacacttgttcttctcagctggctgacttttagaagtaaccaaggtaaaggtgggaaaggcaggctagcttagactcctcctctttgagtagacagggaaggtggaatatactttggggaatggggaagaattggtgggacccccagaaggcaggggctgcactctcttgatggagccttcctccagtttcctatacaccaggactaggtatgtggccatggtgtagtcatatttgttttcccaacaaggactcctggatgtggtctgccttgaaccccatggacaccatgagctgtgtctttccgtggacttggtaatgagggagtggctcctggtgtggccttagtatcccctggtcgttattgactcatggatgccccataatctagcctattgtgttcctcttcctggggttgagggtaagcagtttgttcatgaggctttctagttctgaggaaatgaagaatgggattttgtaattcccgtaacatatctcgtcttgcagttccacaaaggtcagtctgacaaatggcaagaccttgtcaccatggtgtagagaaggtctcccaggctccacaaatccactggggcagggagaagggtggtcataattttgtccctggaagatttctgaggcagcataagggggactcccacaaaatgtgcccagattctggctaacagtgaacctgctgccaaagccagagtctgctgtttttatgttgtaattggtatccagaaggaagttctctggcttcaggtccctgtggacaattttcttctggtggcaatactgcacagtagatactgtttgcaggaactggcctcaggtctctttctcctttctgtggccatactctaggatgtagtcaaatagctctgctctgctggcacattccaggactaaatataatgtttctgttgtcttggttgcttgagagagtttgctgatattggagtgattcaggaccttcattatactgaatatatatatactttggtatagtctctggaggctggaggagctctgctgagctttgtggatgaccttcatggctatctgggtctcagtcagaatatgccaggccagcttcaccttagcgaagctaccccggccgatggtcttgaggaccctgtaattgtaaataagtgtctcctcaccagacaaggtgagaccctgctacatggtgactgatatggtttggctgtgtccccacccagatctcatcttgaattcctatttgttgtgggagggacccggtgggaggtaattgaatcatgggggcaggtctttcctgtgctgttctcatgatagtggataaatctcatgagatctgatggctattgagagtttccctgcacaagcgctcctctctttgcctgccgccatccatgtgagatgtgacttgctcctccttgccttctgccgtgattgtgaggcttccccagccacgtggaactataaatccagttaaacctcttggttttgtaaattgcccagtcatgggtatgtctttatcagcagcatgaaaaaggactaatatggtaaatgggtaccagtagagtggggtgctgctgaaaagataaccaataatgtggaagccactttggaactgggtaacaggcagagatttgaagggtttggagggttcagaagaggacaggaaaatgtgggaaagtttggaacttcctagagacttgttgaatggctctgaccaaaagcctgatagcaatatggacaataaggcccaggctgaggtggtctcagatggagatgaagaacttgttgggaactagagcaaaggtggctcttgttatgttttagcaaaaagactggtggcattttgcccctgacctagaaatttgtagaacttttaacttgagagagatgatttagggtatctggaggaagaaatttctttttctttttttgagacagagtctcactgttgttgcccaggctggagtgccatgatgcgatgtcagctcactgcagcctctgcctcccgggttcaagtgattgtcctgcttcagcctcctgagtagctgggattacaggtgcccgccaccacgcccagctaatttttgtatttttagtagagacgggttttcaccatgttggccaggctggtctcgaactcctgacttcaggtgattcacctgcctcagcctcccaaagtgctggggttacaggtgtgagccaccgagcctggccagccaaagaaatttctaagcagcaaagcattcaagaggtgatttgggtactattaaaggcattcagttttataagggaagcagagcataaaagttaggaaaatttgcagcctgacattgaaatagaaagtaaaaacttattttctgaggagaaattcaagcccttacagaaattacaagtagctgaatgttaactcccaagacaatggggaaaatgtctccagggcatgtcagaggtcctcatggcagcccttcccatcacaggcctggaggcctaggagaagatggtttcatgggccgggcctagggtccccgtggtttgtgcaaactggggacttggtgccctgcgtctcagcagctccagccgtggctgaaaggagccaatgtagagctcaggctgtggcttcagaggatgcaagccccaagctgtggcagcttccacgtggtgctgagtctgcgagtgcacagaagtcaagaattgaggtttgggaacctctgcctagatttcagaggatgcattgaaatgcctggatgtccaggcagaagtttactgcaggggcaggactctcatggagaacctctgctagggcattgtggaagggaaatgttgggatggagcccccacacagagctctccacagggagactgcctagtggagctgtgagaagagggccaccatccttcagaccccagaatagtagatgcaccaacagcttgcaccatccacttggaaaagctacagatactcaacaccagcctgtgaaagcagccaggagggaggctgtaccctgcaaagcctcaggggtggagctgcccaagaccatgggaacccacctcttgcttcagtgtgacgtggatgtgagacatggagtcaaaggagatcattttggagatttaagatttaaatgccctgctggattttggacttggatggggcctgtagcctctttgttttgaccaatttctaccattcagaacagctgtatttacccaatgcctttacctccattgtagcttagaagtaactaacttgcttttggttttacaggcttataagcagaagggacttgccttgtctcagatgagacattggactgtggacctttgtgttaatgctgaaatgagctaagactttgggggactgttgggaaggcaagattggttttgaaatgtgaggacattagatttgggaatggccaggggcagaatgatatggtttgactatgtccccatccatatctcatcttgaattcccatcggttatgggagggacccagtgggaggtaattgaatcatgggtgcaggtcttttccatgctgttctcgagttagggaataagtcttacgagatctgatggttacaaaaaggggagcttccctgcacaagcattcctctctttgcctgccaccatacataagatgtgacttgctcctccttgccctctgccatgattgtgaggcttccccagccatgtagaattgtaagtccagttaaacctctttcttttgtaaattgcccagtcttgggtatgtctttatcatcagcatgaaaacagattaatacagtgtgacctcctagctacactaactacaaatcctaagaatgctaaccagtaatactggtgctacaaactatgctaactaactaatgaacataatactaacaataccaactgtatactgactacactaacagtgataaccaacaatactaataatgctaaccagcaacattaactaaataaaaaatgaaaaaatgagaaaaacaacaaaggaagtggaagaaaaatgggaagaagatataagaatttaaaaagtgggacaaaagagtaaaggaggatgagaaaataaaaagaaaaaataataagaaaaaggaaataaaaaaatgacaaaaagaaaaatgaggacaaagacaaagtagagaaaaaagaaataaaatagaaaaaaacactacacatgaggaaacaacataattgtggtctctgtttgtcaggtcaccaaaaatcagcttactgggctgtgcagaccaaaaacctacatccagccaagtgcttatttaggtgtttgtaattccagaacaatggctccttataatatccagagcaagaaatgggccagttgtagctaggaataatccatagtggttttctcacttttggtctcaagaagcttttcctctttttttttttttttttaaagtgtttattctttaggtgggttatagaggttgatatttattttttttgaaacctgaagtatgctacaacagccttttttatttccaggttcaaaatctctaacaccttttggcttttaaacatgtcataatgtgtacactcaaaatattcaatacctttttctgaattaaactctgaatgtttggtctcaaaatgatgctacaaattaactgacatcatgataccctaaggaaatgttctgttgcataagacacaattgggtacattattaacatctgtagaatggagaggaggatatctattattataatttccccagaagatcatcatcggatttctcttcagaaccttcaggaacacaagttagtgggtggatgtattcagttattgatggaagaaaactgtcagttatgaattctagatccagcaaaactgaaatattgtcatatgcagcaacatggatgaaactggaggccattatgttaagtgaagttagccaagcacagaaaaacaaatattgcatgttctcactcacatgtcagagctagaaaagtagattttatgaaaatagagcatatattggtggggaagcagatagaggatgaaggggggggaaaaagaatgtaaatatatttattaccctgaactgtatacttaaaaatgataaagatagtaaatttcgtatgcgtgtgtgtgtttaacctcaataaaaaatattttaaaaaatgagggtggaattaaaacatcctcagatgtcttagtctttttgtgctgctataacaaaataccttaagactggataatttatgaagaacagaaatttgtttcccacagttctgaaggttgggggaagtccaaaatcaaggctccagcagatacagtgtttgataagttgccctctgctttcaagatggtcccttgtttctgtgtcctcacttggcagaaggaatgaacttgctcccttgagtccttatataaagtcattaatcctatccataagggtggagctagtatggcctaatcatctcatgaaagccccacctctttattttttatttttggtagagatggagtctcactgtgttgcccaggctggtgtcaaattcctaggctcaagtgatccttctgcttgggcctcaaaagtgctgtggttacaggtgtgagccacacctcttaatcctgttgcattggggattaagtttcaaaatgaattttggaggaacacaaacactaaaactacagcaccagatgattcaaaagcttaacgagtttgttaccactagatctcccttcatgaaggaagtcatgaaggttgaaataaaaggacattagacaggaaatcaaatctgtatgaagatataatcatgtctgataaaggtaaatacatgaaaaattataaaagctagtagtgtttctgttttctacatgatttaagagacttatgtatcaagaagttattagtctgtgttttggacacacaacacattgagatgtagttttgtggcattaatggctgaaaggtgatggggttggagctgtataggagcagtttttatatgttattgaagttaacttggtatacattcacatcagagtagtataacttcagggtgttaaatatcagccccatggtaaccaaaaagaaaataactgtaggatatacacaaaaggaaatgaaaaggggattaaaatgtttttctacaaagatcaactaaacacaaaataagataataatgcaggaaataggggacaaaacaactgtgaggcatatatacaaaacaaacagcaaaatgacaaaagttctgccttatcagtgtttaaatgtaaatagcttaaaccctgcagtccaaagacagattggcagaatggatagaaaaacatccagcttctagccataagagacccactttagatgaaagacaaaaaaatttaatgtgacaggatggaaaaagatactctcttcatatagtaaccaaaagagatcggggttgctacactaatatcagacaaaatatactttaaatcaaaaaagtttacgagacaaagcaggacattatatattaataaaaggtttaatacggcaaaaagacaaaacacactaataacagaccactcaaatatgtgaaacatgactgataatggaagggagaaatagttctacagcagtagttggggactttaatgggtagaagaaccaggcagaaggtaagtagggaaatagaatatagtacttgaacaatataagaaaccaagtagatcttacagacatacacggggcattctactcaacaacagaatgcatcttcttcttaagtggacttaggaccttctttaggatagaccatacattaggccagaaattaagattcaagagatttttaaaaatacgataccaagtattttctttgacaaaatgggatgaagtgagaaatcagtaacagaaggaaaactggagactttatgtaaattaagtaacaccctcttcaagaaccagtggtcaaaggagaaatcacaagggcaattagaaaaaaaaggattagaaacaatttaacagacagaaaataaaacattgcaaaacttatgatatgccacaaaagcagtgttaaaggaggaaatttacagctataaatgccttcattaaaaaaaggatgaagatctcaaatcaccaatctaactttttacaccttaacaaagtagaaaacaacaaactcaaagctagcagaaagaaggaactaatacagtagagataaataaaatagaaaaattcagcaaatccaaaagttagttcttggaaaagactaacaaaattgacaatcccttacctagattgactaggcccgagatgagaatctcaaattcataaccacctttctttgctcagttcctgggactgtactctttccaccttggacgatgccatctcctcaacctggaaagtgatatgattttattttattttattttatttttaacttttggaagattttttaatttcatgaataatggtaatgattttttttaaattatactttaagttttagggtacatgtgcacaacgtgcaggttagttacatatgtatacatgtgccatgctggtgtgctgcacccattaactcgtcatttagcattaggtatatctcctaatgctatccctcccccctaaagtgatatgattttatatgtagggaactgtaaaaatttctcacacataaaacccttttggatctgataaactcattcagcaaaattgcaggttacagaatcaacaaaagttctgtttctataacattaacaacgggccgggcacagtggctcatgcctgtaatcccagcactttgggaggctgaggcgggtggatcacaaggtcagaagttcgataccagcctgaccaacatggtgaaaccccgtctctactaaaaatacaaaaattacctgggtgtggtggcacatgcctgtaatcccagctacttgggaggtgggaggctgaggcaggagaatcgcttggaggcaggagaatcgcttgaacccaggaggcggaggttgcagtgagccgagattgtgccactgcactccagcctgggcaacagagcaagactttgtctcaaaaaaaaaaaaattaacaatgaacaatctgaaaaggaaattaagaaagcagttatatttacaatatcatggaaaagaataaaatagtaaattaggtaggagaaagacatgtatagaaagctacaaaacattgcaaaaagaaattaaagactttaataaatggaaaggtaactcatgttcatggatttaaaaacttactattgttaggatcacagtactccccaaagtaagaaatgcaatgcagttcttactaaaatctcaatgatggttttgcagaaaatagaaaaatccatcctaacatggatacagaaaatcatgggatctccagtagccaaaataatcttgaaaacacacaaccaagttggaggtctcacacttcctgatttcaaaatgtactgcaaagctacaccaatgaaaacagtgtggtaatggccgaggttcatatttggactgttggggtttttcaccttagtattcgctatctttttttttttttttttgagacggagttgcgctctgtcacccacgctggagtgcagtggcatgatctcagctcactgcaaactccacctcgtgggttcaagcgattctcctgcttcagcttcccaagtagctgggactacaggcgcgcaccaccacgcccggctcatttttgtattttttagtagagacggggttttgccatattgcccaggctgggcttgaatccctggcctcaggtgatccactcacctccacctcccaaagtgctgggattgcaggtgtgagccaccacacctggcccagtcccactcttgtacatacatcaccaccacctatttccagaacctttcctcatgccaaccagagactatgcaaattaagcagttattctccatttttttctctcccagccatacttgatagaacatgaatatcagataagtgctatggagaacagtaacacagggtgaagtgaaagtgtgccattttatgtaggatggttggggaaagatggcatttgagccactgatggtgcaggagagggaacaagtgtgatattgaggccaggtgtgcttagcagtttgaaagcaaagctagaagtacaggcgaggcagaggcacaagatgaatgttttatattttattttttaaataaaatatttttatttattttaaaaacaatttttttttttttgagaccaagtcttgctgtgttacccaggctggagtatagtggcatgatctcagctcactgcaacctctgcctcctgggttacaagtgatttctcctgcctcattctcctaactgggactacaggtgcccaccaccacgcccagctaatttttgtatttttagtagaggtggggttttaccatgctggccaggctggtcttgaactcctgacctcaagtgatccacctgcctcagcctcccagagtgctgggattataggcatgagccactgtgcctggcctaagaaaaatatttttaagaaaacagagacaaggtcttgctgtgttgcccaggctggtctccaactcctgggcttaagcagtcttcctgcctcagcctcccaaagtgctggagttacacttgtgagccactgcgcccagcctattttattttttttatttttagagtcagggtcttgctctgtcacccaggctggagtacagtggtgcgattgtagctcactctaacttcaaagttctgggctcaagcagtcttctgtccttggcttcgcaaatcactgggattacaggtgtgagccaccacacctggctaatttttaaatttttttgtagaggcagcctctcactatattggttaggctggatttgaatttccggcctcaaatgatcttcctgccctagcctgtcaaattgctggggttacaggtgtgagccaccaccccagtgtttgtttttttgttttttttttttttttgagacagagtctggctctgtcgcccaggctggagtgcagtggcgctatctcggctcactgcaagctccgccttccaggttcacgccattctccagcgtcagactcccgagtaggtgggactacaggcgcccgccactacgcccagctaatttttttttgtatttttagtagagacggggtttcatcgtgttagccaggatggtctcggtctcctgacctcgtgatccgcccgcctcggcctcccaaagtgctgggaattacaggcgtgagccactggcccagcctcctgcgtttggttttttaattctgcttgtttgtagtgacattcatcaagaatgaatgactttaaaacaacaacgaaaaatctttagggatttttactcttgggcaagcatgcttctgtctctgagcattagttttctcatatatcagataaaagggtttggagtatatcaatgatattctggttgtggacagaactcttgagggttccttgaacatgatcctttggtagcattggattgctctcggccatcccacgaatagctgtgttttatctgttttttgcttaagatttaacatatgagttcatttgaaatgtttctgttgccacaaagaaacaaaatccctggctcagagttttaaggggacttactgttctaatgctactcactcaggctttggttgagtagtaaacagactacagcttgtttttaagttcagtgatcttcaacttacagcccctgtgttttacaaatgagttaaattaagatcagtatcttctgttcaaattctttttccaaagaaatccaaatgtgccataagctgataggtctctggccatgaaatatggtttcatagttacattgagattgttgagtagctacagggaaactgagaatttacattctgaggcaaatggtttaacctaagaggaataagattaagtaaactgtgtattagctcctcataatgtggcaggaattcagtgttagcggtggaaaagccacaggagcttaatgtggtaggtaaggaaggtttatgttagttcctttccccgattatcccagttgctgtgcattgccatctcggatcagtttctagccatgactacctaaaagttgtctgagggaggctgtgcactgggtgatcttgtgaggcaggtggacgtctattctgccaagatcttgtgggcccagtttgagaatgggttttaagttttagtccttttacacttcctttgcaggaatgtagcttttgaaatagaagcaaagtgttgtgaaacctttgacattctgttctttaacacttcctcctcagcctgaagatctcagcttttgcttgggcgttacaacaccccatggtacctgaacctcaagtaagctctgttaggttttcatatctgcccgtgtatgatggtgactttttttttttctgagacggagtttcgctcttgttacccaggctggagtgcagtggcgcaatcttggctcactgcaacctccgcttcctgggttctagcgacttctcctgtctcagcctcccaagtagctggaattacaggcatgcaccaccacgcccggctaattttgtatttttagtagagacggggtttctccatattggtcaggctggtctctaactcccgacctcaggtgatctgcctgcctcggcctcccaaagtgctgggattataggcgtgaaccaccatgcccagcctcgatgatgacttatgagtcaatttgactggtcctcaggtgcccagatatgtggctaaacattattctgggtgtgcctgtgagggtgtttctggatgagatttggtggactgagtgaaggtggctgccctccccagcgtgggtgagcttcatccacgggaggctgcttagagaaggaggctgagcaggaaagtcttctttctccgcctgaccgtgcttgagatgggacataggtgttctttgccctctggactccaggctgcaactagagcttaactctgtcagctctcccgattctcagacctcccaactgcaggtcatgggacttctcagcctacataatcctgtgagccaattccttgtaataactgtctttatgtgtaatctattggttctgtttatctctggagagcccaaatactccagcaataatggagtcactttttcccagagataggttttatcttggaggattcttatattgatccttcccatatctctgtttcagaaacacttcctacaatgtagagtgctaatagctggtttgtgagtaccccttagatatactgggatgagcaataaggtcaatgctgtcacctaaccgtctgttgattgtcaagcctttgtgtggaagcaaggaaattcatctagcaatcataacaaaggcaaagcctggagtgtaaggtggttaggtttttggctagcaagagctgcagaaaaacagcctctagcttaaactgagttataaacatatggaactagtgtaggccttgaaatcttttgtggtcgaatcctctttgtaggggaacctaggcaaaatcatgtcatttccactgccggtcccatagcgacttcagttaaggtatagacctatataaagtgttttatcccttaaaaagcttcatctcccatttgcctgtggaatcctccctacaaccctaagaggtggagaggaagcctttcttacagataaggatggaaattgtacagatgcacgaatttgtttctaaagctaagtagaaacaagagtaccaagaggtcagatttttccagcccccaaatccttggcgtaagtgtataaaaagtaagcacagctgttcttgaggtttctcagcctgttgcctcctccccatgttaaaattctggcctgtattcttctaagataatctctgtacccagttgaggattcaacatctaggtatcctctttgggaagcgttcttaaagccctcatataatgggttagattcctgatcacctctaaccccttttgtgttgagagtttcttttgattacgaagtcatacatagtcattgttttaaaacttaaaatatggcaaaccatagtcaaagtcctctatacccccccatcccactcggaggaagaagtcttgactattcttatgacatcatacatttattgccattttcctgtctgcttatccagggtctccttaaaccaagcttgaggtagggagactatcttggtcatctttgcatctctagcagttgggctggtgcaggtgcttgggaaatgaatctgtgttaagatcaccagcctctgaacaggccttatgtaccaaggtctgtgtccagattggcatgacctctgagttaacagtcctttatttagatctttaagactgagttctctgccacagatttgccctctggaaaaaggcacctctcctctagagcagcagctgtcaacctataaatcctgttttgaaaattggaattttagttaaattacagggacagagtgtgattgtatacaatttaattaacatattgaaatagggatgtgaataagactactttaggcattactgaaaagcaaccgagcatttaatgttttcatttatatttatgcctgccaaactgtggcaccagccccatcaagatgtctgtggtgcacttaactgtgcagaaggtgtggagcctttacatttcctctccctggacttggtaccatgtttgcatgttttgccagttatcttaaagtgggattttaaatctattgtaaaacaaaaataaacttcatggtacttaatgccactgaaatatacacttaaaaatggtgaaaatggtaattgttttaatattttaccacagtaatttatgtaggaatactttctataactttgtgctaataaatttgaaaacccggaggggaaattgtgctggcagtgttgaactatgggtcagtttgttctaggctacagatagactttcctgtgtgaagattaaagatgaaaaaggctaaggaggagggacaagggaaaagaaaagtggaaattttaagggttcctgctaactcttcccaaggaattggaaggagtgtttactaagtgttccattcccgtttaagctctcttctcccaacacagttaaccaagcaaactgttacttattctttataataaaattcctccccgtcacagtttttcttaacctcctcaagtcttatcacccccctacttcccaccgtgaccctcaaaatggaagtgattatatgaagacctgaaggattacttaaatctcagtgagtattgagtgccttctgggagtggggagtgagatggggtgagagttactggtcagacaaacttggagtactttggaaggtttgctttggggcatttcttattgttgaagttacctggaccccacttcagtgggagagcctgagggtggagattagaagcagaatctgtttagctagattaggatccagtgagagcttctgcctcaactgtcctgttcagaaagccactcctcctctaatgtggaatagcttcacagtttattatgaaaaaatgtcagacatatacaaagcaaagagactcagtgtaaaagatacactctcctacctactttcaacagttagcattttctgtatttgctttatctgttctttcagttgagctactacaaagtaaattagacctcatgatacttcacctgtaaatgctctcaagtcctttaatctagaatgtggtccctccttccctttttctgtcattatctttagttttggaaagatcaagccagttgtcctaacagagtgtcccacattctaggtttgtctgggtgcatcttttgatgtttaatgtatttctctatccccactctttcttgtgaagtggaagttgggtctaaaggcttgagtacatttagcttatatatatatatatatatattttttttttttttttttttttttgagacggagtctcgctctgtcgcccaggctggagtgtagtggcgcgatctcagctcactgcaagctccgcctcctgggttcaggccattctgctgcctcagcctcccgagtagctgggactacaggcacccgccaccacgcctggctaatttttttttgtatttttagtagagacggggtttcaccctgttagccaggatggtctcgatctcctgattttgtgatccgcctgtcttggcctcccaaagtgctgggattacaggcgtgagccaccaagcccggcctagcttatatatttttgacaagaatacttcattaggaaccttttaatgtctgattgttccactattagagacagtaagtttaatcatggtattaaggtagtcacagccatatcactgcattgtaaagatacttttccttcccctacccccattcctgtgtgattaggaagtgctctgtggggtaatactttggtgccatgtggatcttttagtttcccatccacctttcacctatggtatcactggtgatgtttacctgaatcccttcattaaagattgcaaaattattttttatttcaatcattttaaatacattccttctactggcattcacctgttagattcccgcccccccccccgcccctgcttttcaactaatatagttcctacttaaaagacaggatacattgttttcctctacctacttattttcagagtgaggagttattgttagaagtattcactcatctttaatgaaattgttttgttcatcagattatttcaggagagcaagcaacaagtgagcaaaataatctgggcctggcaggactacagaggtcaaaagggaggacatgagaagccacaagctgtcccacagagatggcagccttctccctcccatttagcggggctggaaatgagctccctgtgactcctttctgtccttccccggctcctcccagtcacctcagtgtgagtgatgagtagtgcagtgacagcctcgaccacataccacatttctgtcctgtaatagctttgctaccgacaactttctttctttttttttttggtaccaaatttctttatttgaaggaatggtacaaatcgaagaacttaagtggatgttttggcacaacttatagaaaaggtaaaggaaatcccaacatgcatgcactgccttagtgaccagggaattcgccccatggctatggggaaattagcctgaggcttagttttcattatcactgtctcccagggtgttcttgttaaagatatattctgccaagccagattcgggggctcccatcttgtgcaagttggtcacgtggtcacccaattctttgatggctttcacctgctcattcaggtaacatgtctcaatgaagtcacacaaatgggggtcatttttgtcagtggctagtttgtgcagttccaatagtgactgattcacatttttttccaaatgtgatgcacactccattgcattcagcccactctcccagtcatcacagactggtttcttgatatcctgaaggaagatttggccaccacgatagttttgcagcttcatcagtttctcggcatgttccctctcctcatgagattggtgaagaaagtatgtggcaaagttcctcaaagccacatcatcgcggtcaaagttgtaagacacggacaggtaaacgtaggaggcgtagagctccaggttgatctggccgttgatggcggcctctgagtcctggtggtagttctggcgcacctgcgaggtggacgcagttgtcatggcagcaactaaggagaggtggcggcggtggctgcgcggcgctggagcggcggcgggggccttgggatggtccgagggtgcagtgaagaggggacagagggctggctacgggcggccggccggggtgggggacgagcgctgggttccgtccaagcactgttgaagcaggaaaccccgacgactctcggcgaagaatgtctctgctacccacaactttctcactgtgccaaaatcagtgcctgtccagtaccctcgccttttctacctctcctctgctagcgatactgtgtttaagtcgagtgaccttcctctccttcctcaccatccctgcttctcacacttacccatactcttactaaatcagcttaccattactcttgctaattcaactcaagtaatacaattaaacacctcctaaaatgaagaaatcccttacatcttcagttaacctctgtcttagttcctttgggctattgttgcaagatatcttagactggataatttataaacaacagaagtttattgcccacagtttggaggctgaggaagtccattatcagggctccaatagattcactgtctagtgagggtcacacttctggatggtgtcttttatgtgtcctcacatggtggaaggggcgaggtggctcgctgcagccactttcctaagggccctagtcccattcacaaggtccctgcccttcctgacttaatcactcccccaaaggctctacctctacttttttttttttttttttcccgagacagagtttctctcttgtcgcccaagttggagtacaatggctcagtctcggctcactgcaacctccgcctcccaggttcaagtgattttcctacctcagcctcccaagtagctgggattacaggtgcatgccaccactctgggctaatttttatatttttagtagagacggagtttcaccatgttggccaggctggtcttgaactcctgacctcaggtgatccacccacctcagcctcccagagtgctgtgattacaggcatgagccaccacacccagccaggccccacgtcttaatactgtcactttgggccttaggctccaacatacaaattttgcaggggcattaacattcagaccagagcagcccctctacttagatgtacaccaatgtaaaaattaacatgaactctgatatgctccactgaatacagagactcaaacatggcaccctcaatatataaaatcagtatgtttgcaaaattgcatctctccagaggacagaatctgaaccagttgtttaaccagtaagtttcaaacagtgaaaccaagtaaataacagttattcaacaataaattaggacacccaagaagtcctgggtaaccaccgtcatgggaaacagaagacaggtctttcactaggacagaaggcataaaattggactaaatttattgtatggttcttttctgggatcatgattttaaaatcaactaccaagaaggtttgaaaataaaaatcaaaagtcgaccatgattttcttgggggaagagaaaacagctcctgaaccaaagatcactgtcgacactggcagagcagatcccataggaatggtcatacattttggttggttggtttgtttgtttattttttgtagagatggcagagcagatcccataggaatggtcatgtgtgtgtgtttggtttttttctttattttttatagagatggggttttaccatgttaaccaggctggttttgaactcctgaactcaagcaatccacccacctcagcctcccaaagtgctgggattacaggcatgagccatcgtgcctggcctgggtcatatgtttaactctttgaggaactgccagactgttttccaaaatggctgcaccactttacattcccaccagcggtgtagaagagttctaatttctccacatgctcgtcaaaactcgttttctgtttttttttttaattctagtggtcctagttggtatgaagtggattcttctttcttttgaccatcactggggtctgatttgccctgataccatctcttgctgcagccttcatgcctagtgcctgatcctgcctcaccctgctgcgcgttggcattcagatttgacttaaaatccgagtggctcagcctctgctctgaattgtcccttcagtcaggtgtttgcaactagtctcctgaggagttgctgggtttgagtcacagaatacaagagggatgccccttccaggatctgggggttgggaaagtgtggcaaggcaggtttaagatagaagaggaagtcagctgtagcaagcaaacacatagacctgggctgtgggaccctcggaagggatatggagccaagctcttggagtgcctgaggaattagcccaaggagctttggctttcagtagctgctcctgtgtgtagcaaagcaggctggagtagagtgaagggagcctggggtaaggaaataaattaggagtcaagaagtaatgatgcaactaggattgtggaaatgtaaagaggttagggaaagatttgtatggctggggctaaaccagatgtgatggttggggtaaagggacataggaagtggttttgggtatgagaacaagagaaagtgttcctcttgggaaggacagacggggtgagtggaaagtttctgtctaatgtgactttaggtgctaacacaacacaaggcagacgtttgcagcagagaattaagaaaagctgaagctggaatccagattcagcaatcgtgaatgcagtgagaactgaggcaatgcagagtggctgctgcttccatgtcatcccctcagatagatatctgcagcctcctggcctctgactataccttttatttatttattttttaaagaacagcttcattggaatataattgccatacatgttgaaactatacactttgagttttgacatacatatgtatctatgaatacataccattcaaagatggtatgtattgtgtgaaaccatcaccatagtcaagagaatgaacaaatccattaccctgaagtatcccagtatttcttcgtaattcaccctcctgcctactgcccttccttacccctctccaggtaaccactgatctgctttctagttcgcattttctggtattttgtataaatgggatctgtatatatactttaagtatactgtgtatttatttgggggggagtatctggcctcattcgacattattattttatttgtgctgtatgtatctatagttcattcctttttgtagctcagtggtatttcattgtatagctatatcacagtttgattagcctttctgttgatggacatttgggttgattcacgtttctggctgttacaacaaaagctgctgtgaacactggtgcacaagtctctgtctagatctgtgttttcatttcctttgggtaggtagctgtttcggaggggaatggttggggcatatggtaggcatatgctttaactttgtttaaaaagttgaaatacttaatacatcataaaatttgcctatgtaaagtgtgcgtgttttgttttgttttgttttgtttttggagacagggtctcattctgttgcgcaggctggagtgtaatagtttgatcacagctcactgcaccttcatcctcccaggctcaggtgatccttccacctcagccccacgagtagctggaactaagggcacatgccaccacacctggctaatttttttttttttttttggtagagacaatgtctcactttgttgtctaggctgctctcaaactcccagcttcagcctttccaccttagcttcccaaagtactgggattacaggcgtgagacactgcgcccagcctaaagtgtgtgcagttcaaatattcacaaggttgtacaaccgtcaccatctaattacagaaccgtttcttttctcttttcctttcctttccttttttctttctttctttccttttttttttttttttttttttttttaaggaaacagggtctcactctcatggagctgggaccacaggtgtacaccaccacacccagctgatttttgtaattttttgtagagacagggtcttgccatgttgcccaggatttcttcaaactcctgggctcaagtgatttgcctgtctctgcttcccagagtgctgggattacaggcatgagccaccacacccggcccagaacattttcatcaccccaaagtatatatctaacttttaaaatggtttttccctttcacattcttaccagcagtgtacaggagttccatctgctccatatccttgccaacacagcatggtcatttaaaaaatttttagcctttctaataggtatgtgatggtgtctcattatgtttttaatttgtatttccctaaagattagcagtgttgaacagacatgttttcacctgcttattctttggtgaagcatctattagatcttttgcccacttattttattgggttggtttttttcttactgtgtttgagagttctttgtatattctgattacaagtctttttgtcagatatgtgatttccaaatattttctctcagtctgtgtctttccattctattaatagtgtttttggaagagcagaagctcttagtgttgatgaagtccaatttgtcaatccttctagggattgtgcttttgatgtgctatctgttaaaagacaaaattacaacacatttaaagatcttagttggcttttatttgcaattcgtgaatgagggcagcttccattctacaaaataggatgaaaactcccaatgggcagtagcagaagaatgggctttgtaaggtgggaacagtgaaacagtaattgaaagataactgattggttaacatcaggttacttttttgtaaggattaaagcagagggtagttccttatcatgcctgctaaaactggcttgtttgggtattctgtctctcttgattttttagaaggtcagataaacaacttacttttcttttttccttttttctttttttttttttttgagacggagtctcgctctgtcacccaggctggagtgcagtggcgcgatctcggcttactgcaacctttgccttctgggttcaagctgttctcctgcctcagcctcctgagtagctgggactacaggcgcctgccaccacacccagctaatttttgtatttttagtagagaccagttttcaccacgttggccaggctggtttcgaactcctgaccttgtgatcctcccaccttggcctcccaaagtgctgggattacagcactggcgtgagccaccacacccagcccacaacttacttttcgtttggtgacgtggaactttagctagagtgactctgttttgtttgatctagtctcttgaggcctagtacaggagctcagtccaaatcagtggcctcctgtcatttttgtttaacatatctaggaaatccttgcctaacccaagatctgacagtcttttgaaatgggactggattttaaactaagctaggatctcaggtatccagaaggcatttaagtttataacgtgtctcaccggatacgctggagagtcatgggggaggagaagaaagccagttacaaaagtacatcatcagttgttcagtcatctgtcagtttatgtgtgaatgcccctcatgagccaggtctgtaatccagtgggcagtccccatctcctgcattgtctctgtgacttatagtttcgttctttctgctgtcaaatgaatatataaagaaaatatccaaaaacttaataaattgtaattaagaaggcaaatctcccatctttctcttcctgaaaaaatccaagtgtaaatgattttttttttaacataaagcaaatcgttatactactcttttccataaagcatttgggaactgattgcttgttagggtaacctgaaagctctgccactatttcccctaatatttaaatgttaagaaagggaatgtgactttttttttttttttgagtcagggtctcactctgtcacccaggctggagtgcagtggtacaatctcagctcactgtaacccccacttcccgggttcaagcgattttcccacctcagcctcctgagtaactggcactacagacatgcaccaccatgcccagctaatttttgtatttctggtagagacggggttttcatcatgttagccagggaggtctcaaatttctgacctcaagtgatccggccgcctcagcctcccaaagtgctgggattacaggcgtgagccactgggcccagcctacaattttaagttctataattggtagaaaatttcctcagtttggggggctcatcttcaagagtggagactaaagtaggttctgtaattgcgctggctaaagaacaaagaattctatagcactgtgagctggagaatgttgtagcaggttaataaggggcttactccattttgtcagtaaccagcattggttccaggaattcaagaggtggtgagatattatgcttaatggtaataagataccacttattggtaatgtaccaggcattggtctctggcatcttaccatctttgtactcatatcttcacaggagcacaagaaaattaaaccatccaccttttacagatttagggatttagtagaaggctgaaggaggccagataactgaacttttacttgtacagctaatattaagtcggtgcaatagtaattgcggtttttgcaattacttttaaagtttcagaaccctgatttgaagcagagcgtctgggagtctcttcgttctgttataccagagttgttcttgtatgtgaataaggagcgtatctgaatgccttggcttcagccctggaagccattgcattctgaccaacctttgtgtaaccattttgtagactgtgaggactcttgtcactccttaaattctctcctaaacatattatattttgcttctgaagatgatccaaataccctcaaaactcaggtggagatactgttaaaagatagttttcaaaaagggtaagatcataactcattttaaatataaaatgaacacatgttaaaaattttaactcataagacaagcagttacaaccagttcagggagagtaggacaacaaagagcagacatacatgtagtaatgtcagtaatgtcgaaatgaacacaactggcttttccacagggaaggattatcaagacagttcatttacttatccatggacaagagtgatttgcatttccctcagttctacacaacttagagttgctgaagggcagtgaaaggctagaatcatataacctagaaggatgtgttccaaagcttagagtataaatctaaatattgcagtttcccattggaaacatcccatggtcttttttaaaatttgtttacagaatgtgagagtttataatactattgtctcgtttttttttcttccataacatatttaaaattcttgcttaaaaatgtttttgatggggatagggggttgtgaattaaattcctaacatgtcctaatagttacatgttatgcctaatctgttagtgtacttgggtgatatgacacttattttaagcctgatgcacttagaagcatgttctactttggatatctgttctgaggatggtagctacaaaatgaacttgtgccctttcgcaaattgttggacttgtggtggttgtcttgtgtccctagtatctgatttggaagactcaattaagggtttaaaagcctgcagaaggcgcgggccgccacgcctaactggttttcatatttttttggtggagacggggtttcgctgtgttggccgggctggtctccagctcctaaccgcgagtgatctgccagcctcggccccccgaggtgccaggattgcagacggagtctcgttcactcagtgctcagtgttgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggctgcccatcgtctgggatgcgaggagcccctctgcccggctgcccagtctgggaagtgaggagcgcctcttcccggccgccatcccatctaggaagtaaggagcgtctctgcccggctgcccattgtctgagatgtggggagcgcctctgcccggccgcgaccccgtctgggatatgaggagcccctccgcccggcagccgccccatctgagaagtgaggagcccctccacccagcagccgccccatctgagaagtgaggagcccctccgcccggcagccgccccatctgagaagtgaggagcccctccacccggcagccgccccgtctgagaagtgaggcgcccctctgcccggcagccaccccgtccgggagggaggtggggggcagcccccgcccggccagccgccccgtccgggagggaggtgggggtcagcccccgcccagcaagccgacccgtccgggaggtggggggcacctctgcccggccgccccttctgggaagtgaggagcccctctgcccggccaccaccccgtctgggaggtgtacccaacagctcattgagaacaggccatgatgacgatggcggttttgcagaatagaaaagggggaaaggtggggaaaagatagcgaaatcagattgttgctgtgtctgtgtagaaagaagtagacatcactttgttctgtactaagaaaaattcttctgccttgggatgctgttgatctatgaccttacctccaaccatgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggcctcagggtcctctgcctaggaaaaccggagacctttgttcacttgtttatgtgctgaccttccctgcactattgtcctatgaccctgccaaatccccctctgcgagaaacacccaagaatgatcaattaaaaaaaaaaaaaaaaagaaaaaaaatttttttaaatataaggtaatctacatcttctgatatggaaagaggtctatctatatattcccctaatatatgtattaactaaaaaaaaaaaaaattaaaaaaaaaaaaagcctgcagaaacttacgctgttaggtaagagttggcagtctgactcccctaggagtgacttcccccttctccctttctaatgtcagcaagagataaatgctatatggccaaaatttttgattcctttgatcttaactctttgtggtgttgggtggagagtggttgggagagggtggcaaaaaagttcacctttcaaccagtcttccagtcagttggatcatcttttgaactgaaaggctcttggatcttttttttttttctcccagaaacagagttttgctctgttgcccaggctggagtgcaatggagcaatctcggctcactgtaacctctgcctcctgggttcaagtgattcttttatttatttatttatttttgagacggagtctcgctctgttgcccaggctggagtgcagtggcacggtcttggctcactgcaagctccgctcccgggttcacgccattctcctgcctcagcctcccgagtagctgggaccacaggcgcccgccaccacgcccagctaattttttgtatttttagtagagacagggtttcaccgtgttagccaggatggtctcgatctcctgccctcgtgatccgcccacctcggcctcccaaagtgctgggattacaggcttgagccaccgcacctggccttgggttcaagtgattcttgtgcctcagcctcccgtatggctgggattacaggtgtgagtcactacacctggctaatttttgtatttttagtagagacggggtttcaccgttgttggccaggttggtctcaaactcccaacctcagatgatccacccaccttggcctcccaaagtgttgggattacaggcgtgagccactgcgcccggccgacatcccttcttaatgtccttttcttaaatgtatgaggagtgggccactgagcagggagagccctggttggggtcctttgattggagaatagcagtaataatggggaggagaggtagaaatgcaacctggacatttgtaggtctttggccacagcttgtgttcagatgggaactggtaggccacctggcttttagtgagactgttcaccttgccttctgttgagccccattgtcttggtcaactgtagttcagtctgtcttccgttagtctccacccttcctccactagcagagaagaggacacatttgcctttcacctggtgtaacatccctcgcctcttccccttctctcttttcttagtagcagtgccgtaccacattctgtgggcttcctgatttgagaactctggggcttgtatcccatggatggtggtagaggttaagtttaagttttctccatttgtcctgagcaggcataatgttatgctttgcattatttactacacttgttttggagcattaaaaaattccaagtgtggagacagattatcctttacctaaatgaatttgttttactttgggatgttgttggaagtggtcataaggaaattgttgaggaatataaatctagccccatgaaatgcctgttaagtagaattctttttttttaacttgacaagtaatttttaattgataaataaaaatggtatatgtttgtggtgtacaatatgatgttttgaaatatatatacacacattgtagaatggctgtatcaggctatttaacatttgcattacctcacatactttttttttgtggtgtgaatgtttaaaatctagtctcagcaattttcaagtatacagtacactgttattaatcatagtcaccatgatgtacaacagatctcctatttctcctgtttaactgaaattttgtgtcctttggccattgtctccccagtcaccctaccctcaggttctggtaactaccattttactctctgtttctatgagtttgttttctttagattccacagataagtgaggttatgctctatttgtctttcctgtgccaggcttatttcactaaatgtaatgttctccaggttcatcctcgttgtggcaaatgacataatttctttgttttaaaaggctgactagtattccattgtgcatatatgccacggttttttttttctttttttacaggcagggtctcactgtgttgcccaggctggagtacagtggtgcgaacacagctcactacagcctgggtctcccaggctcaagtgatcctgatcccttagggcccagctgcctcatcctcccaagtagttgggaccacaggtgcacaataccacacccagctactgtattaatttttttagagatggggtttcaccatgttgcttaggctggtctcaaactcttgggctcaagcaatccttctgtcttggcctcccaaagttgcaggattacaggtgtgtgccactatgcctgaccaactacgttttcttgatccattcgtccatggatggatacttaagttgattccatatttcagttactgtgaataatactgcagtgaacatgtgagtgcagatctcttccacgtactgattccatatcctttggctatatcattggatcaaatgggagttctatttttaatactttcagcagcctccatactgttttccataatggctgtactgatttacattcccaccaacagtgtgcaagggtgccattgctccacatcctaacaccaatctttgtctttttggtagtagccattctaacgggtgtgaggtggtatctcagtgtggctttagtttgcatttccctgatgattagttgagctacacacacacacacacacacacacacacacacacacacacacccctattagtcatttgtctattttcttctgagaaatgtctttttaggtcctttgcccattttaaaaattagattatttgttttcttgcaattgagttgcttgagttccttatatgtttagggtattaagcccttatcagatatatgttttgcaaatatattctcccatttcgtagattatctctgcactctgttgtttctcagtatgattctttttttctttgagacagggtctcactctgtcacccagccgctggagtacagttatatgatcactgctcgctacagccttgacatcctgggctcaagtgatcttcccacttcagcctcccaagtagctgggactacaggcgcatgccaccacacttggctaaggttttctttcttttgttttctgtagagatggggtctccctatgtggcccaggctgttcttaaactcctgggttcaagcagtcctcgcaatgtattgggattacaggcaagagccactgcacccagcctctattgttcttataatacttgataataaaacacatgtgactgccttgcaaaactccttagaactcctcaggaggactgtctccaatctgatgaaactaaactatcactagcagattttcacacctaatcagagaaaactttgtgttacacagaattgtaaaaatttgcattgaagttttaaaactttaccctgctcagccaaggactctataaaagctgctccagtcaatcattgtgatcaatttctgtttagtttttgagatggagtcttactctgtctcctgtgcagtggcgcgatcttggctcattgcaacctctgcctcccgggttcaagcgattctcccacttcatcctcccaagtagctgggattacaggtgtgcacctggctaatttttgtatttttagtagagacagggtttcaccatgctggccaggctggtcttgaactcctgacctcaagtgatctgcccgcctcggcctcccaaagtgctgggattacaggcatgaaccaccgcgcctggccaaagagccagtatttttattgtgtgtcaggagggaaagaagatggtgtagatatcaagtagtgaaatgagtaagggctataaattgagtcttgagatgtttgaagagtatatattaatcctagtaaaatgccttagaattgtttagaccaacactgtatagtagaactgtccaatatagtagctatggctgagagactgtatttgagatcatgcaatttcctttaaatagccaccggtggctagtaactgttacattggacagttcaggtttaaactagttttctcaatttttttcattattgtacctctcttttacccctaagcctttttagacctttttttcctaatgtctcccctgcttcaatgaaattttaataccgtggatatgctgtgcatacattgtggctcctagagggctgcagatccatgttaattatcacctctgttaggaatgtgtggtctagactaatcagggattggcatcatagtgaagcctaaccaactgttgttatatttcttgggcagttaaaatcactaaaggctaatcatacttacgatgagtattattcagaacttcagaactgagaaagtttttggagttttggaagtttataaaatgctcagtcatcctgtttttcttcatatgtgacattcttaaagcatcaacttgttttagtaatggatagtacttgtacaaagatacagacatttaaagaaataaaaggagcctaatccagccagaggtaggcaaccaagaagttaaggcatctagaagccatgttgcttgcagaagagttgagagaaccagagatgtacagttttggtgatcgatagactgggtgtctcaaataataagggatatcacatgggaaaaggattagattggtactttgctgcctcacagaacaaggcagggagaagaactacacagagacagaatctagttcactgcatgattttgcagctagaatagtttgaagatggaacactgcataggaggaagttaatcattattgaaagtgtttgggcagaaaccaggtgatgtttcagtattgtggaccaagtatatcgactaatatagagctgaaataaaatgacttttaaggattcattgtggggctgggtacggtggctcacgcctataatcccagcactttgggaggctgaggcgggcagattacctgaggtcgggagtttgagaccagcctggccaacatggtgaaaccccgtctctactaaaaatacaaaaatttgccgggtgtggtggtgggcatctgtaatcccagctactcaggaggctgaagagttgcttgagcccaggagacaaaggttgcagtgagccgagatcacgccactgcactccagcctgggtagcagaggaagactgtgtctcaaaaaaaaaaaaaagagagattcattgtggctgagtttcaggtgctttggttttgttctacagctggcctcaccatttctaaatacatagaattgtaaccataagaggtccattacctgatgcatgcagcaatgctgagacactgggttgtagcagagaaagagttgtgtgtgtgttggggtggggtgggggggtggtgttggagacaggatcttgctctgttacccagactggagtacagtggcaagatcatagttcactgcagccttgaactcctaggctcaggagattctcctgcctcagcctcctgagtagctgggagtaggcacgataccatgcttggctaatttcttattttttgtaaagacgaggtcttgctgtgttgcccaggctggtctcgaaactcctggtctcccaaattgttgggattacaggtgtgccaccgtgcccagctgagaaagaggtttaatcatagggccacctcatgaggagataggagagaactgcacatccatttccctagggagtttggggctgggatttctaagggttttaagtgggctgaagtgtggagattgttgattggtcaaagagtgcagagtgaagtcatgggacagggagagaagctgtattctcatgctgatcatgttcctccatgggggtcttcaaactggttgctggaattggggtctgatatacatcttaagcaatccttaaataaaagccttatgattctaatgtcagagatgctgtctataggaacagtggggacacaaatcaattttcacacaattttatgaccctgatgttagaaatcctatctctaggaacagtggggatgcaaaaagtcagacttgtagcaacaaggaaaggggccaaagtacagtctgattaatgctttgttgtaactatatttctatccagaaccagcaggccatttttttcaactctgtggaggcggtttcagaattgtgtagatgcccttgtccaggaaggagttgtgaagtagctagttgaatatagccactgaggtttccagtttaacacttacaaagctacaggacacaatcttgtacttaccagcttatagagaactgagatggcccctttttgaagtaagaaagtgtttacagttttgtctgcaggtcatccccagcacctagctcagtaatggacacttcatggcactcagcaagtgtttgaactggatttggtgtgtttaccccctagctcatggtcagtgactactgcttctgaattaaaaatagcaacacatgatcagatttaagtggggccagaaagaggctgttagggcataggatattttagcatgaagtggataggatcatgagtggtaacccatgttcttagggcccatgtgcctatgtggtcactgcaaaacaataaaagtggaggcaagaattcaaattagtatatgggagtgagccacttagtgacccagtgcccatgtttcagtgctgctttgtttttcttctaacaaagggcatttttgccctatgtaaaaattggtattggccaattaggacttcacaaaggtctccatatcttcctcaaatgacaagggtcttatgctaaatgtgactctctactgccctgtttgttaacatatgatgcagtacaccaatgcagatcacactgcagttttaggtagtatatagctgaatgcataatttgtattagaaatacaacaaggacattagactcatgtctgcattgacatggatacagcaaaaatcttgaagttagtgtgagagattacagtagtgagatttggaagatggaataatacttgttgattaagtgcatatttttcatttaagttagaaaagccctcataacaaagccacccatatttcatgtgtcaaatggaatgctaggagctttctgtgcattatctcatttgtggaggattctcatttttcacatggaagcagaggggcatttaagttcacacagctgccacttggggtagcttatccctgtaatcccagcactttgggaggccaaggtgggaaagaatgtgtgaacccaggagtttgagaccagcctgggcaatgtagagagacctcatctctaccaaaaaatttttcaaaaaagaaaagctgggcatggtggcgtgtgcctgtagtcccatctgttcaagaggccaagggtgggaggatctcttgagccccggcggtcgaggctgcagtgatcatgctctactgcactccagtctgggaaggagggagagaccttgtctgaaaaaacaaaaaacagttcacacagctgaatgtatctgaggtgagattgaaacccatggttgtggccgggcacggtggcttactgtaatcccagcactttgggaggccgaggcgctgaattacctgaggccaggagttcgagaccaacctgggcaacatggtgaaaccctgtctctaccaaaaatacaaaaatcagttgggtgcggtggcacgtgcctgtaatcccagctcctcaggtggctgagacaggagaatcccttgaacttgggaggcagaagttgcagtgagccaagatcgcgccactgcactccagcctgggcgacagagcgagactccatctcaaaaacaaaacccatggttgtgatcctaaaaccggaaggttggctttccattgtcttgttttggcaatttctagccatctttctttccccagtgttcagtataattagcagtcttcctgagaatttgggagcatttccttctggttacctacaatagggactgtgatctcaagttccttaagcatctttgaatgggacaaaatagaacctggcctgctaccttgcacatgactagctatggagccttagacaagttgtgtaaatctcgaattctcaggaagaaaatgccatttgagctctagctgaatggagaaacactgcacatgccagaaccgttctccctcatggtccatccaggctgatgcccgcatgggtggagatgcttgctgtcttcctccctgtgcccttttcccagcctcacaagcagcgtgtgaggtcacctttgatggtgccacataagctccatgggctggctctaagggacagcactgtgttcatggcacaaaggcctgctgtgaccagtagtaacagcaaaagtgactgtaccttctgatacttagccaccccttcttgtgacacacatcagcatgcctctgttgtccatagtaggctctagtaggatgcagggctgtcagcagaatttattgaaacctggaaatggcggggtggggggtgggggaagtgcccaggcattctttatgtcttgtataatctctctagattttgtttactctcttcaactatttattaccaaaggatcacaggtcaccaagcatgaggaagtactgtctatacgttttaagtaagagtccaggtaacacttattgttgttgctgcttcagagaattctccttggccagaattgtcagcccaccttttcttgcttagtggtatatatgaggtgtcataatgggcaagaggttcaaagtcttcatttgagtaagagagtgtcttgtgctaagcatctgcagccctcaggggaacctaaaagaaggcactctcacagaggcagtgacccaaaaatgtatatctaaacaaagacagattggcattctccatcatctcttacttggcctctgggcatgtccactgtccctgcacaattgtttaccaagcccttgcaccacaggcactactgggattaggaatttggggatgaaggagagaataccttcaaggagaatttatcccccgcccccccgccccccacaaacacacacctcccacctgctctatcctcctcctgccctacccccacttagatgagaggcagagacccaggtagtcatgattcaagtatgcttttcaaaaaggtgtctgggccccaggtgctcttgcgtttgagggagtagtatccaggaagacaggctctcaacactgcctagacctcacctgccccctccagatgagcaggctcctgggcagaaagggcattacattagggggtgaggtgggaccctgtgggaggaatggcaagcccatttgagacaagccgtgtggtggctgggaacgaggtgtattctggagaaggactgtaagggtagactagatatctccctcacctggctgcttttatgtgcccgctcaggcctctagccttggtggatctatgccttcgggccttgttcctgaatcccaactgtctcattggcctgccaggataacttactgcgccacccccctgatgcttagctgctctctgtacctgaaccatcaatcttgctctttctcattccagtcatttaacattttccagcatgctttctgggaacttctctgaagcttgttaagggattgataaccagtaaaatgttttgaccagttatttttaacatgctgaacacttctttttaggcattgcacgttcagctgtttagtcttgcctttgaaaacattcagtatttctgctggtagtgctctctcctttgctgtactttgccatgattatgtcatctgggccaccagacagcagacctctagatggcaggtccagccatctcttctcttttgctttccgtgtctggtgaatgcacgtaacattcccaatttagcacaggcgtctagatagacttcagccataaaatcctagcacaaactagtattccctcagttaacagtgaagcttaaatataactaaataccactgtatctttaaaaatagatttggttgagaatcacctcaaacttagcatgtctaaaatcaaacacaattcctccccaagaaacacgttactgtttttcagacttccctgatctaagaaatcctcttggtcccatgagacataaacacaggtgacttccttggcgttttccctcatttcccatacccatcccaatccaatccatcactagatgccatccacctttactttctccccattctcttctgctttcacactggtctagtgcagtcctctcttgcctgaaggtggcgcagcatcctcactgtccaccgcagggtctcctaccctccccactgcaggcaggcagggcgctggctctgcaggatgaacactgctgcttagaaatctccacaagtcaggcttctcattactctgtggttttgggaccttagtacggcccactgtgtcctgcgtgatcaggcccaggcacctcattttcatatccccctccaagtaaggccttgcatgtgcgttctttaaggaaaactgtttgttcccttttcccccttcatatccaggttcagttcttcccagaggaatccttccctaattctcccaaccaaggtaattacccttaaagtaaacttaacacgtcttgatcacagtagtattttactttttgcatttggtatgatttctccttatagtctcgtatctacttttgcccttggtatatgtttgattaatatagtaagattaataacacaatgattagtagtcctggggcttaagagttctattcatggcatgattttttttttttttttttggagacagtctcgctctgtcgcccaggctggagtgcagtgatgcaatcccagctcactgaaacttctaccccccaggttctagtgagtctcctgcctcagcctccctggtagctgggattaccaaatattggagtagagcttcttaactctgtagaagagagaacagaattacatttttgcatctgggcacagtggtgcatacctatagtcccagccactcaggaggctgaggcaggaggtcacttgagccacaggagttctgggttttagggcattataccaattgggtgtctgcattaacttcggcatcagtagagtgacccctcagaagcaggtgaccaccaggttgcccagggagggtgaaccggcccaggttgcgaatagagcagatgaaacatctctcctatgctgatcagtagtgggattgcacctgtaaaaagccactgcactccaacctggacaacacagtgaaacccgtctcttgaaaataaaaaattaaaagaattttttaggctgggcacagtggcttatgcctgcaatcccagcactttgggaggctgagccaggcagatcagttgaattcaggagtttgagaccagcctggccaaaatggtgaaaccccatctctactaaaaatacaaaaaggcgtggtggctcgcacctgcagtcctagctattcgggaggctgagacagagttgcctgaaccctggagggggaagttgcagtgaacagagatcgcgccactgtactccaacctgggcgacagagcaagactgtctcaaaaaaaaaaaaaaaaaaaattctttaaggtatttggtcagctccttgatgtgcttctctcactagatattttcattgtaatgaaagtgtttatcctgcccccctagatccttaatgtttcttttcaaaggcttctgtcttttcctactgagtttcttcctagaggtggtaattctaaatggaacaacagactgacggcctacttcccgagtgcccccaaatgacttcataattccacaaaagtggcttggccagagccatccactcatccccttccttcttccttgtcagactactggtctttctattcttgccccctccccagaatgaatatttttagaaaccaagtgactcctgatgagcttctttttcttcatctgttaaatgggaattctcattgtatccctataggcttggtttgttggaggagtaaacaaattgccccaggaaagtctgtagtacagtccccggcacaaagtgcattctgtaagtggtagtgatgtcttgctgtttcagggggtcttcactattcaggccctaattagattcctcagtttgggaagttgagaagagtctgcctacaacagacactgctgttctgcttgatgcccagtgcagtagtattatgtgactttcgatgcctttctggtctctcctcatgaccttctccaaaactttatgagcaaatattgcttgcctacttcactctgagccttgaagtcaatcagttttgagggcaagatgactgctgggtcttctctaatggtcatatacagagcatgaagtcttggaagaaaatgagatggacagagagacatttacccatgttccgtgctggtgaaagtgtggaatgttactttggaatctgctcagaagcctgctacttccgaactctgtatccctatgatgcttccttcccagtgctatatttagatcatatgtgcaataagtcacattctagtaggcagggtaggcaaagaccatcagcagaatgagagacacatggatgaaatgtattctactaatccaagaaatgccgagtgattaaaacatttgtgagtctgatcagattatgctgacagagtgtatatgtaggttcatctcatcataattgaaaacaatgcatacttagcagcaagggaaattttgagattatccatgtgctgaatatcatgcaaccttaatgttaataacatgggaagatatttaatatagaaaaagcaagatgcaaagttatacatggtatataacctcaaccatttgaaggaaaactagaaagacatatactctaatactaatagtgattgcttctgggagatggaattgtcagtagctttttgtcttcattctttcgtaccttcctgagttttctacaatttgataccatagttagggtgggaacagtgcaggggagcagaaaagccaactgtgattaggacccagttgttgcagacaggcaacttggaaacaccaaccaactaaaaatgttaacaaactatagaacattaattggtttaactgtcatggctttgttgaacctttagcatttgttcaaatatctagtgctatcattacggttttggatcgggcacaacatgtaaatcagaacagtagttgtagactcttcacatcagtggtttccaaacttggtgtgtatgcctgaattgccataaaagacttgttaaaagtcccagccctcacaagccagaatcctcctttgggtgagagctggtactgcaaaatggcatggtaggacctgggctgacactcctggtaattccagctctgccacttcgttgctgtctgactgtggatgtgatgaacacctggttcaatttcatctcctgcattttacactgttgttttgatggctttgcagatatagtaatcctctttatctgcagtcaatcgtggtctgaaaatattaaacgggaaactatagaaatactattcttaagtttctttttgtttgtctgctttttgagacagagggttgttctgtcacccaggctggagggcagtggagcgatcatagctcactggagccttaaactcctgggctcaagccatcttcccacctcggcctgccgagtaactgggacttacaggagtgtaccaccatgcccaggtaatgtattaaatattttgtagcgactgggtttcaacatgttgcccaggttggtctcaaaactcctggccttaagcagtcttcctgcctcagcctcccagagttctgggattacaggcatgagccactgcaccctgccataagttttaaattgcgtgctgtttggattagcttgatgaagcttgtgctatcccacccaggaagtgaatcatcgctttgtccagggtttctacaccatagatgctacctgcccgttagtcacttagtagctgtcttggttatcacatcaatgttgcaatgcttgtgttcaagtaactcataattgacttaataatggtcccaaagcacaagatgctggcaatttggttatgccacagagaagctcttgaagtgaaaaggtaaaaattgttgacttaataaggaaagtgaaaaaattgtatgccgaggttgctaaaatttgtgagaacatattttctatctttgaaattgtgaagaaggaaaaagaaaatcatgctaattttgctgtgacacctcatactgcaaaaggtaaaagccacagtatatgatgagtggttagttacaatggaaaaagcattaaatttgtaggtggaaaacatgaacatcatcaatgtgtcctgacggatgacaagtttggtacttgctgtgtttcaggcattcactgggggtcttggggcctaccccccatggataagtgggtactactatactttgctttcaattcctgcaacaccataaagccttcacctccacgtgagctgttatcctacctgcaagaattcagactttcgaattgctaactgacccccaacttcctagcccttccctgctgtcctcattttcaccatagcagtcctttgcccttcccctaggtacccctgtgtattcctggttaacctctttctgaccaccgacctctgcccacccaagcccttgaacaatatttttcttgatctttttacctgctcatgtttccttattttgtctgcttatgtggccatttggcttttctgtggcatagatgaagaaggtgatgactgcaggcgaataaaggaagatgccagcttttgatttgttatgagaaacattgtacttgaaagaaagaattgtttcatcgttcaaatactggtaccaatactggtagtttcgctctgaggagcttcttccgatgcacactggtgaggtttggtttggtggcagaaggaaagaaatgtgttatgaatataccttattctagaaaatttttagaggatattaatatatacatggattaatggatgttatctaaaatgctttccttgaaggaccaggtctcagagatcttatgtaactctttcttcctttctactctgctggctgcagattctcctgtgagaggaagtggtcggtgctttagagaactgttttccagttagaaatttcaaactttgtagccttttttttttttttttttttaaatctttgacttcatttcgctctgttgcccaggctggagcgcagtgatgcgatctcggctcactgcaacctctgcctcctgggttcaagtgattctcctgcctcagcctcccgagtagttattacaggtgtgtttcaccacacccagctaatttttgtattttcagtagagatgggtttttaccatgttggccaggctggtctcgaactcttgacctcaagtgatctgcccgcctcagcctctcagagtgctgggattacaggcatgagtcacccatgcctggccataggcttttaaaaaataatttcagtcttcagaaatccatgaagatggaaatagaaattgataacaaaagcagaaattgcttttggacattttgaagctaactctgcttgggcagcttcttgtagcaaaagttgcatttagtgtgttttgttcctggcttttttttttttttttgagatggagtttcactcttgttgcccatgctagagtgcagtggtgtgatctcggctcactgcagcctccaccttccaggttcaagcgattctcctgcctcagcctcccaagtagctgagattacaagcgcgtgccaccacgcgcagcttaatttttgtatttttagtatagctggtgtttcaccatgttggccaggatggatttgtcagtctcttgacctcgtgatccacctacctcagcctcccaaaatgctgggattacaggcatgagccaccacgcctggcccctggctcttttctagaaacaagtgtcccattcttgatctgggagaacattaagtacaaaaatataccttttaacttttgccagtttaaagccatcaatgtcctggtgaaagaagatgtggaattcttagtatcagctgtttagtaccatttgcaacaactctgaaatgcttagccagccctgagtgaagatgaaaatctgcatttaaatgtaatttgtcttacatgatgagtggagatttttgtcatcagaaattgatttgaaaaaatcaacagattaacatttttctccaaagtggaggtggctgtttgagtgtaaaggtaatgtgctcctctaagagtcacagttaagtataaggaaacaaaaacatctgtaatcccaccacatggaacaacttgctaatatttgtgtatattcctttctgcttcatgtgtaaccatttttacatttaaatctttactcctttgggaatctcttggaagaggagatgtagagatcttaattctcaccaaaatttttctggctcttaccatttagtgaattgttcatctttttgccactgaattttataatgccatatttgtcaaaattgttcatttctggtgtctgtttcattgatcggtttagtcctattccagcaccccactgttaatactgtatttttataacatgcttttcaagactgtaaaggcaagtctcttgtcatttgtgttttaggggaagggacatttcttgtgtatttatttatttttatgaataaaaacgggattgtttatattaaatgctccccagcctccccttcccacctcaaaaacaacaacaacaacaacaaccctggacttgtttaaataggagagaatgcatgaatgcaagtctttacattaaggctcccatagactgtttattcaaattctttttttctctgtaaaattatttttctcatttaggtcctgtactcgtgctaaccactgtaatagtgattgttgtataaatgggaaaaatctttcaggaaagtgaattagcaaaaatcatgaaaacttcttcatgttttgtttgtttttttttttaaagacaattttgctcttgttgcccaggctggagtgcggtggtgtgatctcagctcactgaaacctccgcctcctgagttcaagcgattctcctgcttcagcctttttggtagctgggattagttgcccaccaccacgaccagctaattttttgtatttttggtagagacagagttttcccatgttggccaggctggtctcgaactcctggcctcaggtgattcaccttccttggcctcccaaagtgctgggattataggcgtgagccaccgcgcctggccaaaactttgctctggactcagaaatcccatccctaaacagaatctgtgagttacagttgacaaaatcctttccttgcatgagaatttgacttttgtttaactttctagctctgtttccctgggagctagataaggcagaacataacatttgtttctgggcatggtccttgtggtaaaatgtcccctggttggtaaattacatttggatgggaaagagccatggataagtgatgggccacccaggcttttgtttcatggaacacagtgactctgctgggcatgtccttatggggagcctaaggagctgtcaaaagagatacttgcacccccaggattgagcattctgagtcaaggtattgagtcggcacagtctccctgtgcctgagccatcttctgtatggactcttgcaagaactgctgctgctgatgacctgccactgccctgcctgccagctttgtctgtcccagtctttctcagtgggcttgtgccacatgtggcctgtgataatcttacgagtcagaatctagaaagatctacccacccatcaaccctcacacaggtgttgctgtatctcaaggaagtaatcccatagattacagcattttttccaaatttttgttatattaaataaagagcgggaatggctatttaaatgcttaattcactcagaggaatattagacattaagacgtaaggtggtctcacggtcactgctttgtgacacgtgtgggtagagactcaaagggaaggaaacaaacatgaattctatcatgtaggagtctggaggttgaagtgtatttcctgttttttttctttttaatattattaaacagcattggtacaccagtgaaacctattaacaaagcaagttatgcaaatcccttttcccattcttaaaatcagtcactttcataaatattctccaaatatctttgcatatccttttatcatctttttatctattttctttttttttcctttttgaaaaagagtcttgctctgtcgcccaggctggagtgcagtggtgtgatctcagctcactgcaacctctgcctcctggatttaatcgattctcctgcctccgcctcccgagtagctgggactacaggtgcgcaccaccacacccagctatttttttgtgtatttagtagagatggagtttcactatgttggccagggtggtcttgaactgctgacctcaagtgatccacctgcctcggcctcccaaagtgctggcattacaggtgtgagccaccacacccagcctttttttcccttccccaccactcactgcaacctctgcctcctgggttcaagcgattctcctgcctcagtctcccgaatagctggaattacaggcacccaccgagctaatttttatttatttatttatttatttatttatttatttatttatttattcatttgagacagtgcctcgcactgtcacccaggctggagtgcagtggcgtgatctcggctcactgcaacctccgcctcccgggttcaaacgattctcctgcctcagcctcctgagtagctgggattacaggcgcgtgccaccatgcccagctaattttgttttgttttttgtttttttgagacggagtctcgctctgtcgcctaggctggagtgcagtggcgcaatctcggctcactgcaacctccacctcccgggttcaagccattctccagcctcagcctcctgagtagctgggactacaggcacatgccaccacgcccagctaatttttcatatttagtagagacggggtttcaccgtgttagccaggctggtctcgatctcctgatctcatgatccgcccgccttggcctcccaaagtgctaggattacaggtatgagccactgtgcccagcaatttttgtatttttagtagagacagggtttcatcatgttagccaggctggtcttgaactcctgaccttgtgatccacccacctcgggcctcccaaagtgccgttattacaagcatgagccaccgtgcccagccttttctatttttagtagagacggggtttcaccatgttggccaggctggtctcgaactcctgacctcatgatttgcctaccttggcctccccttctttctatttgaaacttgcccccattatcatcatctgatctctatcttgaaatatgataccagaccttagagtgtgacatttaaactttgaccagtcaaagcggtccctggggagaaaggtaggggaatagtggggctccacatataatggatagtttggggtatacctctcagtgctgattatgatggaagacagaactccaagtcatcttatactgcccctaactagcactagtaagaactttctagatgaatgctggtgggctgagataccgtgtcttcacagtccagccatgggcatgaggcttttggcagagaaacagcttgaccctctgcataggtcatgggacctggggtgtgtgcctagcaaaccatcctctagtctggctcctattcccatactgttcttgtagccagaaacagactctgaagccatcgaggatggttactttcaagagcgtaggccttcttagcaaatcctgccctttaggacagtagtcaggtctgatatttccttttagttagtggtcttgggtgtaataccacctcttgagaaagagaacaattgacagccaagcatctggaaagagagggatagctggattaccttgcctaggagctgtaacctgctgcttctctcactgtcttctggactctgtgttctgttactcatctctgtatttggcataccttaagatggtagcggccagtatttactagtcatctgctgtattctagttactgtcctgagcattttatttattcagtcttcacagcattcttaggacataagagctgtcatctctatattccctattccaacagagaaattaaatgactggctcaaggtcatatagctaaattaataagcggcaaaaccagaatagaaatccctgtggcctgggttcatatctgctgcttaagtcactcccactataggcactgctgtcagccttgccttcaaaaggtaggtggttaaagaggaaactaacaagtagttcttctgagtcccattcattttctggaagtcactgagtcataccctggcaaatgagaggcaattacagcaggagccctgtcttgatgagtagatagaccatgctgtggcaagtcctggaagacagttgagcagagatcaggcatttttcacatcttctggttatgagtagacaaggctgcctgaaagattttctggaaaagagtagtcactagagctgcagagtcaagtattcagacggtacccaacatttaataaatttctacttggcattgagtatacagtggggagtaaaactgtcttcatggagattgttagaaaagggatagactagattaatatagtacataaaaatgtcaattagtggtaagtgctctgaaggaaaagcaagcagagtaacgggatagagagcaaatgaggggttatgctgctttaaataaagcggtcacttctttgagaaagtgatactgaagcagcgacctgaatgaagcaaggaccaagctgttgagtaagttggagcattagttcaaattgccaatccattcaattgatccaccacccaagtgagagaatacattctctccaacagcttgcaggggcaggatggccctgctgtgctgttctgcctcgctcttgggtccagagttttggtgagtgatactgttttttatcagtgccccctggtggaaggaagatacctagcaggaaggttcagggccctgcactgttggggctgctcagacatttgtgcaagggaggtgttttgttttggtgtttccatcacactcacagtgatttctccttttccccctttagtttgaaggatgacctctaggaagaaagtgttgctgaaggttatcatcctgggagattctgggtaagttactcatgaatttgagctaacagattggcttagagctaagcctctctgctgtggagcccacactgtccgtgctgccacttcttgctttcatagtgaggcttagggccttacatgtttccctccacggcagaaatttagatgatcccttgttatataaccttttgttctctagtttttagcatgattttttatggggaacggatggctatttgaactcaactaaggataggcattttcatggaatcccttttctccaagctggccaggctggggagtcttccttacgtagatgtattgccattggcatctggcgtagcagatgtgctttttttttttttttttggagacagagtctcgctctgtcgcccaggctggagtgcagtggcgcgatctcggctcactgcaagctccgcctcccggattcacgccattctcctgcctcagcctcccgaggagctgggactacaggcgcccgccaccacgcccggctagttttttgtatttttggtagagatggggtttcaccgtgttagccaggatggtcttgatctcctgacctcgtgatccgcctgcctcggcctcccaaagtgctgggattacaggcgtgagccaccgcgcccgacccagatgtgcgttcttagtgcaccatacagtatcctcctgctgctgtgcctgcttcagatctatctgcaaaagagcctgggacggcagaactgggttctgattctagatgtgccactaaccatgtagctaactctaatggctcttaagattctgtggtaggttgggtgaggtggcttatgcccataatcccagtgctttggaggctgaggggaggattgcttgagcccaggagttggagacctgtctctacaaaaaaaatttagccaggtgccgtacctgtagttccagctgctggggaggccgaggcgagaggatggcttgagcccaggagtttgaggctgtagcaagctatgatcatgccgttgcactgcagcccgagtgacagagcaagaccccaactcttaaaataaaaagattctgtggtaggcttttcagacttggcatctgaagggacccatgaaagctttgactcattggaagcttatgtatttttaaaaataacaacaatagcaaatgcaggtatgcttctttattccaaagtcccctgcccttcctttgaaaagccagaggtttttctgtcttgactggcttatttgaatcacctgcagaacctttttttgtatgtgtgtgagagacagggtctcgctctgttgcccagactaaagtgaatggtgcaatcacagctcactgcagcctcaacctcctggtcttaagccatcctcccacctcagcctccagagtagctgggaccaccagtgtgtgctaccactcctggttaaatttttgtattttttatagagacagggttctaccatgttgcccaggctggtctcaaactcctgggctcaagcagtccactcgtctcgacctcccaaagtgctgagattacaggcttgagccaccatgcccagcctttgaagaaccttttgttcgctagcatttgcccagccccagaccagtgggctagggcctagatttgtgctctctctcctaccccgcaactccatccccgtcgggatggaaagatagtgcttttaggcctgccttccccaaacttgtgcaaaaagtctcaccaagcccttgttcgattccaggttttgccacctctcaccttgtagattctggcttagatggtctgggttggaaaacactgccttcggctgtctaggtacctccaggttctttaacacaaatatgaacatgttcctttgtggccaagaaaggtgatatcactggctatgggggggaaggtttttgtattagctttaggttaccttaaccttatcacacaaaaatcacacattgtctcttgctgagttttcttactagaaaacatatttggaggagcattctttgaggtggatttgttttggtgatatattggtgctttttctgcttcagattttaaactttaaagcagcaaattgtctgagtggtgtgtgtctgctgaaagccaaggtcttcctcctggtgttacttcatcaagctaaatagcagccactaaatggagaaacatctaagatagcagggatactgttggaatagcagaacagtcttaatagtgaagcttcttttagaaagcagtatatttgctggcatccttctagaatggaaaaaataatactaggctctaccatttgacctggctgtgccaaaacatgtaagcagcttttccacatctgccccacatctgtaccctatatttttacccagagagaaaacacaaaacttcaaaagtgtaatgctcggaaggctactggcattgccctttgctgtgagggcagtttcttgtccttcaggtcaggcagattcttttaaatgcttcaagtaattcgtgtcagtttcaggaccctcctatttgacttatacttatggtttttctccaatttcagagtcgggaagacatcactcatgaaccagtatgtgaataagaaattcagcaatcagtacaaagccacaataggagctgactttctgaccaaggaggtgatggtggatgacaggctagtcacaatgcaggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctttaggtaaacatctttgtctcacctcagtagtgagacataaactttatttttctgacttcctatttcatacgtaacttcaagagttgtgtgtctattgagccaatcttttttttatgtatcagcttattaatctttcaagggttccctttcaacagttaggataagatacagattctttcatatgacttgttgaaaagccttcacattctggctataaactattattccctttttttcccccattgagtcattttgtttgtatacatgtattaacatccctagaaaagaaacccctgaaggatggataccttgagcccaggagtttgagcctgcagtgagctgtgactgctccattatactccagcctgggtgatggagtgagaccctgtctctaaatttaaaaaaaaaaaaaaaaaaaaaaaagaatcccaggattttccctcctgtattttcatctctttcttcatggtccatgatgccagctgaggttgtcagtacaacctcactttgaaaccaaactattgggataggagtagattatcctgtcatttttctagatctttgagttgcacatcacatctggggccaatcattccaggggcagttttaacctgcctgtgaggtttacagtaattttcccagctctgtgatgaccagtgatttcaaattttcaatgtgatcatgtttcatcttcacacttagaaccagaccatgacttgggagcacagcctaataagaacctggtgtttgcccttgagagcatcagccaagacgttcatgcattacggaggcaagaaaagatggtggaaatagctgttactcactttttttttttttgtctcgttccagtcattccgaatcatgtgctgctcttacagacttgtgttggtggatatgtctctgcttccagcagggcctgtatacccacctgaagtctccaacttttagctcagatctttggaaacttctatctccatggcagttgttctttcctatgtgcttctagaggcaaatacaattctaatcccattatagtcctagaaagtacctggcaaatagtgggggcttgctgaaatgtgtgaatgatgtaggttaaaggtagaaatttgtgcacgtgttgacctcgagccatggcatgctcctagaggatcaggactcttaattgactcacacttctaggacagagctggtatgaatctctcatcctcacctcacctacacacatacacctagagatcttcaaaatgtaactacagtttaagcaagtcaagcttgagagtagaactggaaaaccttggcccaagaaattggcaaagcttgtgtctgcagttgttggagattctcagtcccactctccacatgtacagaaatctttgtctcaaaggatttaacataaatccctgtcattcctggcaaaaacaagggtaagaccactctgtagggacatttagtaccgcaggagagaagatgagttcataaccacatgaggaaataatgtaccacaagagatgttcacaatgactagagatgttctaaaaagaaatagaaaccataatggaaagggatactataaaaaaatgaggatatggaaaacttagaacttcaagaagtgaaaacatagtattgaaataagctaaaggaacagttaaactgtagattaaatggagctgaaaaaagcagtaagccgtaagagctgagcaaattttctaaaagaagacttaaaattgtagaagaccgaaaagcaaaatcttaagagcaactatagaaaaaaaagacatgacttataaaggaacaacagactgacaaattctcaacagaaggcagaagggagtagaattacttcagggagctggggtaaaggcccatctgaagattctccatgtgtcacagcaagactcagactgccttttgctgagggaaaatagaacttctccagctgagctgtggttttggtagccatgtgggccagcgaattcagaaatcagagttcggcccctgctgggtcgggggttgtcataacagtcccgtctgtactactaagctgggaccttggggcgctgcactcttgaagtaaaccccatcaggagatccacagcgcactgtgggcttctcaagaagcccaaattccaggaaggataaataaaaagaattctgtgtaagtcataatgaaactaaaaaagaaaaaggcttaaaaatagactgaggaaaacctgacaagcacagcactgaggctgtcaggtgactcttggcagtagcagcagagcccagcaggcagtggggtatgttgggaaagagacgggcagcacagtgttctgtctctgctgaaataaccctcctgaatgaaagagtacatctttaagggctagtggcagaagttctaaaggataactccaggcagaaagtgatttcatgtagatgaggaaagagtggaaaaagataacaagttcccaagagattgaagcaaaaggatgacccttgtgctcttgcagccagcttcagatactagaagtaaatgaaaatcattgtctctgcacaaaggcgtcattatcctgatcttgaggaatcctcatgtgtttttcgagggcttttagcagcttgcagtaaaacataatcaaaataaaacaaggcaccacaagaaagaaccagtggaaacttccctggtaattccagagtgttttttgtatttaaagaaataaggaggatacagagtttcagttatatgagatgaataaatcctagagatgtgtacagcatagtgcctgtagttaacaatactgtattgtacacttaaaaatttgcatgctggatgcggtggctcatgcctgtaatcctagtgctttgggaggccaagagaggagtttgagactagcctgggcaaaatagcacatttcatctctacaaaaaaattttttgaaagaatttactaagaggatcttattttaagtgttcttatcacaaaaagtaataataagaggatggggggaaccttttgatgagtaggtttgtggcctacattgtagtgatggtttgtgtgcagcctttgtatgtcagccatacctcactaaaggggctttggttaaagataagataatcgtttatctgcagggaagaaacgaaacagttaacattgatagggggagaaaatgaagcacaatcaatgaaatttggaaattcagagaatgctgctaaatcatagcagattggccacaccagaaaagggctggaagaatgaaagaaaaatggcaggaaatatgaaagaaataagtgaaagtgagaaggttggacctacttttaatcagtctcagaaggtgtaaagagagaataatagatcaaagatgatatttgctgagaattttcgagaattggtgtggcaccaatccactgactcaagaagcccaaattccaggaaggataaataaaaagaattctgtgtaagtcataatgaaattaaaaaaaaaagacttaaaaatagactgaggaaaacctgacaagcacagcactgaggctgccaggtgactcttggcagtagcagcagagcccagcaggcagtggggtatgttgagaaagagatgggcagcacagtgttctgtctctgctgaaataaccctcctgaatgaaagagtacatctttaagggctagtggcagaagttctaaaggataactccaggcagaaagtgatttcatgaagataggtctgaaggaagaacacttcaatagtatacttgtatctatttttggaatcgtgagtatgtaacttccaaagtaatatgaggaaacaaagatcagaactgtgtaatctaatgtgtagggaaagattagtgactgctgtgtttcttgttttttaaagttctctatactgttcagaaagaatctgaaattgattagtatcttagatggaatcaaataggcatgacaaatttccagggaacagtttattgtgagtttgtggtagtttaaacagtgatattagtatagtaatacacagagcacaggaacagagggcacagggtgcacctctctggtaatacatggagagaagggtgttgtagggtacatattttattttattttatttatgtatgtatgtatttatttatttatttttgagatggagtctcactctgtcgcccaggctggagtgcagtggcgtgatcttggctcactgcaacctccgcctcctgggttcaagcaattctgcctcagcctcccgagtagctgggactacaggtgtgtgccaccacgcccagctaattttttgtattcttagtagagatggggtttcaccatgttagccaggatggtcttgatctcttgacctcatgatctggccgcctcagcctcccacggcgctgggattacaggcgtgagctaccacacccagcctattttttattttttttgagacaggagtctcactgtcgcccaggctggagtgcagtggcctgatctcagctcactgcaacctctgcctccccgattcaggcaattctcctgcctcggcctcccaagtagctgggattacaggcgcctgccaccacgcttggctaattttttgtatttatttttagtagaaacggggtttcaccatgttggccaggctggtctcgaactgccgacctcaggtgatccacctaccttggcctcccaaagtcctgggattacaggcatgagccactgcgctcagccagtagggtaaataagtgggaccaggacagggctttacattctagcttgggggaaccagaggattcaagacctgaaggtggaaaaaatacaaagtgaaaacttaaaaaatgaaaatagtgaatacttttcacctttggcatttgaaaatacagaaagtacaaatcataaaatgttgaagattgattaatagattacattaaacatgtaaataacaagattcccagactaacaagaacaaaccacacaagcaggtgacaaagatgataatgcctaatagtatccaagcagtaggtaacctggtggatgctagaatatagggagtggaacagcctctggttgatggtaggagtgtagtaatgagtacaaccttttcagtagaaactgccactctgctccccagtgttgaacatagacatatgcagcaatccagagttctgagtctgagtgtatggcctagagaaacttatctctggacattatgagagagttgtaatgagagttatcattgcagccttgcatggggagtgaaaaactgcaaataactcaaatgatctggggaactaagtgagtctattaaagcagtggaatattatataactgttaacttttgggaatgaaaaaagacaagttgcaaaaagctgtacaggatgataatgtttatgtaaggcatctcttcaggagcatttacttgtggtgaagaaggaagaaaatgcaatgagggaagggttaactcttggaaaaaacggataaaaataacagtgttaatttttgtcacatcagaatattgggtagacagttataagggtataattttaaatggagaaaacaaaacattttgaaacaagcaggctggctggtttcctgttttgatgtggtctagagaaaaagaataaaagccccttactcaagctgtagcttacctaacttccaaacaatcagcaacaaaaaaccccgagaaactgttatcacaagttcctgcttcatggggctagggacctccctgggcccccccccgcccccagcatgtgcagttagacttcaacttcaacttatagttaccttttcctcattttaatgccaaaagtcacacccaggatggagatttaacctgctagtgctacacgcaatttctgaagaagcatgtttagccactgtgcatgcactagaaaaacccctcctatatacatatcctgacatcacccctccccacaggaaagccctttaaagttaactcccacactgctttcagagaacagctgcccctttccttttgcagtgctagctcactatgcataagctaatacactttcactttctctttgctattgtgtctggtgatctctcttgatttctatcatggaagattccaagaacccaggtcgctgttaacaatttcaattaaaatattaaaaaatttaaaaatcacagtcagccataggactgtacttgttgatgttttgataaatatggcctttacttttgtaaattcaaagttaaattaattttggtaactttctaggaacccgtcaacttgttgacttctttttgatgtattactttgccttctctgtgtatctgagttccagatgatgaattggttccacctaacagtaacagagttcttatgtaattttgcttgtaggagtctatctgaaaaaagccatttgacatacagagaaagctctctatgctaatgttcattgctgagttgtttataatgataggaaattgtcagcaatattttcttaaaaataggaatcgatggttcactaaatctgttgggcagcagtaaagtccagtgaacctgctctcccatgtcaccccatctgctgttgccagagtgccctagtgcgtgacggggtagaggggaggaacttgggagaatgtggagagtatcacatgtgcagtctaggagtgcagtctaggatttcagctacagaaaacctccgcgcatatgactagaacaagacatgaactccttcctgtgtgggaggatgccaagtgttcttttgtttgtttgtttgtttgtttgtttgagaatggggtcacttctccactgacagagatgcatacatattccatgtagaacattggagaaccaggagagcacagggatgagtaccaccagcagtcccgatcctgtttagtctacatgtgtggactttgtttattgtatctgggcaagggagcatttagtgccctagcctgccgagaggcagtggagtcattagaaataaatttgtcttttttgcccttcatccttatatctgagttgttatcatgttcgtccggctctgtttgagtgcctgttacggatctagggcagtaagtatacccagccttgctcttaaatctagcatggcagtgaatgaggtgaccagcttagagctgggcggtagtacctggtttaatctttactctggtgtgtgttctcattgtctttctcttgatctctttttgtcaagagtttttcatttgttttgttttttgaggtataatacaaatgaaatataacatgctaatcttttttgttgtttaggcaaacttttctcttttttttgagacagagtttcgctcttatcacccaggctggagggcaatggcacgatcttggctcaccgcaacctgcgcctcccaggttcaagcaattctcctgcctcagcctcccaagtagctaggattacaggcatgcaccaccatgcctggctaattttgtatttatagtagagacagggtttctccatgttggtcaggctggtctcaaactcctgacctccggtgatccactgtgcctggctaggcaaacttttcatacagtaaaatgcatagattgaactatatcactcgtgagtcatcacctcacttccctattgaactgtatcattcgtgagtcatcacctcacttccctatatttccattgctctcagaaagttcccagagtacctaagttttatttatagttcaaattttacacacttacctacatgtgaccactacttggatcaagatataagaaatttctagcaccctggagattggactcaatgtcactcgcttatagacagacacatacttaatcacaatatttgtgaggattgtttcagatactctggtgctgaaatttgcttcctgaagtctggtgtcatttgtctttgtgggtggccccacaatctagcctatttcttctggcaccccttgcatacatgctcctggtgctctgcctagcattctcccaaggaatgaatgttttgtctctcacagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtaagtaccaacgatgatagatattgtcacagacacctgctccccaggggccttgtgaatttggagggttctctgctaagctcacatggctctaggaggtgctggtgggagtcttcattaccatatgccagcccttcaggccaactgcctttaaggaccgggacccaggtgacctgggttaagtccccatcctgcccccagctggctgtgactttgggccattgtcttggctgtctcagcttcacttccctttctgcactttgaaggagggaattcggttttgtcattctcagtagtgccctcccagtacctccaggccatgcctggatctccatgtgtgcagaatattgctttgggctttgagtaaaattgctgtactgtagtttcaaataccatttctgttggaaacatagactctttgattaattacaactaggtttatttctgaccacagatcttttcttaagtgacttagtccttatctcttggctgaaaatgggctaggggttggggaaggaatgagaatgtgtgagtggcataggtgacatcacactagcagtaatggtgaagggactataaaccttaagaccaagctgctgggcatttcctgtcctgggatctctgaggtcccagtaaacactcttcatttcttcccggactggcttcttactccattcacaaatggcttttaagtataactgagggtcagaaggtatgagctgtagaccgagacaggctttgagctctctagctgaatcctagctatcctgagcatagctagcaggacaagtttggacgggtctgcaggtctcctccaacaccctctttccccatgtctgtgtcctcacctgtactacctgtagacgaggggccatgacacttcctggggaggatggagtcagtgctggctgcttctgtcatgagcctatgtgcaccctgcttcttctttcaggtggccacaaagcgggcacaggcctggtgctacagcaaaaacaacattccctactttgagaccagtgccaaggaggccatcaacgtggagcaggcgttccagacgattgcacggaatgcacttaagcaggtgggtctcccacagctgaccagcccactctggtgatgcctgaccactgacccagtccctgcctggcctcctgcccttaatcttcttccctaacccactcttttctgtatagccagaataccctatgtgttcatctgggaaggttatgacatgttctgcttaagcttccagaaatcccactttggggggaataatataaaagatgcagaggctgtgaagtctgaggctgcccttcttttactaggcttgttcttattttctttgctgtgattaggagatcaggtcactgggagaccccgaacagattgctgcttctatttaaggaggaaataaacttgaatatgaatcccagctctgctgcgtaccaatcgttatatctagtttgggcttaaaaaaaaattatggccgggcactgtggctcatgcctgtaatcctagcactttgggaggccaaggcgggctgatcacttgaggtcaggagttcgagaccagcctggccaacatggtgaaaccccctctccactaaaaaatacaaaaaaattagccagacctggtggtggtcgccagtaatcccagctactcgggaggctgaggcaggagaattgcttgaacccaggcggcagaggttgcagtgagccaagatcgtgccactgtactccatcctgggtgacagagtgggactctgtctaaaaaaaattaaaaattaaaataaaaaaaattatatctgaacttctaccccctcacctgaaaaatgggaatacctgcttttgcagggtgattatgaagattaaatgagacagactcttccagctctcacatactgactggtaacttttttccttaggaacagttaagtaaacaacacaaagaaggaagaagatgtaggaaaactattcaaggaatataatacctagaatttcttatttactgtttctgtgattagatacaaccactcatgcgagttgaaagtctgttttgatgtacagctctgttaggggcagtggtgattaaggcaggtcacgaggcctcatcagacagtgtctgggggtggtcagaggtgtggcaggtttgggaggatgcatagaacacttgaagcacatggtggctgtgaagggcaaggcagattctgctgactccaggaagccggctgaatgaaggtaatggctttcagcaggacaaagagttgtttgtaatggttgctccaaggaccagggaaattctggcatgggtggggtctgcactaagtgttccagaatgaaagggacagatctactcaatgaggaaattgttccacccagaatgccaggagagccctcaagtggtaaggagcagaccaagatgcagacttggccacgcttacccccaaataataatgtttgtgtttttcttaatgttcatataagggaatggaaatccaaatatgtgtaggaaagtgtttcccacctgttccctgttgcctggcatcactgtctgagtttttctcttccatcactactgtccctgttgtctttatgcttttatttttagagctagcccttaagaagttagattgttaaatcggagggtgtatcttattgtaagtcagggtgccaggttgctttccccaaggggaataacatttcagcaatgtgggcttgctttcttctacctccttgccagcaagcaataggtgtcacctgtcactgctgacattgccgatctttgggtgtgtaaattgccaccatcgtgactactggtccctctgagttcccctccctggggcttagccatttggattttctctgctgcacacagccggcacacagcacatggttgggcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcagctatgttacacaagccgtttccctccctgaatagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtcttttttttttttttttttttttttttttttgagacggagtcttgctctgttccccaggctggaatgcaatggcgtgatctcggctcactgcaacctccgcctcccaggttcaagcggttctcctgcctcagcctcctgagtagctgggattacaggcatccgccaccatgcccagctaattttggtaattttttagtaaagatagggtttcaccatgttggccaggctggtctggaactcacattgtgaaccgcccgcctcagcctcccaaagtgctggggttacaggcatgagccaccgcacccggcctgccacatttcttttttaataattttgtttccaccattttcctctcttaccttccacaccccaaataaaactctgttgagattttgattggaatttttttcttcaagcccactgttttttcctcattgattgcagttttgttgtggctgttgcattagtctgctcaggctgcgttaacaaaaccccacagcctgggagggtccaacaacagacattttgttttctcacagttctggaggctggaagtccatgagcaaggtgctggcacatgtttctggtgagggtgcttttctgggctatcttctcactgtgtccctcccatgccctttctgctgtgtgcacagagagaggacacatgagcaaggtgtctctggtgtcacctcttcttataaggacacgaattctcagatcaggtccccatcctgcaacctcatttaaccttcattccttccttactccaaatacagccacctgaagggttagtgcttcaacacaggaattttggaggaacacaaacattctgcccagccgagtgcggtggctcatgcctgtaatcccagcacttcgggaggctgaggcgggtggatcaccttaggtcaggagttcaagaccagcctggccaacattgtgaaaccccatctctactaaaaatacaaaaaattagctggcgtggtggtgggcacctgtaatcccagctacttaggatgctgaggcaggagaattgcttgaacctgggaggtggaggttgcagtgagccgagattgcaccattgcactccagcctgggcaacaagagcgaaactccatctcaaaaaaaaaaacaaaacattccacccatgatactattttaggtcttgtttctgttccttcagtaagattgattgattctttttttttttagagacagggtcttgctctgtcagtcaggctgatacgcagtggtgcaatcatcactcgctataacctccaacttctgggctccagcagtcttcccaccatagcctcctaagtaggtaggactacaggcacacccatgctataattgatttataatatgatcctttgcctttcacagtaaacatattcctaggtactggtgggaatataaaatgtcactatttgtaatagccaaaaagtaagaacaactcaaatgtccatcaactggtaagtgaataaacagggcagcttatccatgcattctaatattattcagctataagaaggaatgaagtagtgacacatgctgccacatgggtgctaagtgaaggaagccagttgcaaaaagaccatatgttgtacgattccatttcagtgaaatgtccagcccggatgcagtggctcatgcctaaaatcacagcactttgggaggctgaggccggaggatcacttgaaaccaggagtttgagaccatcttgggcaacatagcaaggcctcatctctactaaaaattaaaaattagctaggtgtggtggcatgagcttatagttccagctacttgggaggctgagactggaggattgtgtgagcccaggagttagaggctgcagtgagctgtgatcatgccattgcactccagcctgggcgacagagcaagactctgcctcaaaaaaaaaaaaagaaagaaatcacagtccactagaagaaatggggaaaattaaaataaataaataatgtttaaaaattaagtgtccagaataataggcaactctattgagacagaaagtagatgagtggttgctgggtccaggatggtatagaatgggggtgggaaggaactactaatgggcatagggttttttggggggtgatgagagtattttaaacttaatgttgatggctgcccaactttctgaatatactaaaaaccattgaattgtacacttcatggcatgtgagttaaaacccagcaaagctattaggagtgcaatggcaccatcttggctcactgcaaccttgacctcccgggttcaagcaattctcctgcctcagcctcctgagtagctgggattataggtgcttgtcaccatgcctggctaatttctgtatttttagtagagacggggtttcaccatgttcgccaggctggtcttgaactcctgacttcaggtggtcgacctgcttcagcctcccaaagtgctgggattacaggcgtgagccaccatgctcagccaaagctgttatttttttaagtatgtattcctagatgttttatacttttatagttattgtgaatggaatgatttttttcctagataacttttaatgaatagaaacagttcctgctttatctccaaattctagaacagtcactggcacacaagtgctcagtgtttaagtgacattgttttcctgcacccaaaagtagaatgctgctcctcattggaagcatgttactttagcaaagtgccactaaaatgaccatagtccatgtgctctgatcacttgtcacagatggtgataaaattcattcacagcttcctttctaggcctgcagcatttgggagacaaaactctgctaaacctttggaagaaaaaagagaccagaggccattggtcccgaaaagtggatggaagatagggaggtagaaggaatgttacaggctgagagggcagctcacactcagctccagccacttcacctcgtgcacacactggctgagggttgccagatgtttgagaaaagctagaaatccagaccattgttaaccattggcaactatagggaacatacagaaagcatctgaactggatgtggtagagctcccagatcatgatctgattgagaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgat

SEQ ID NO: 1935 - DNA, 70806 bp, Homo sapiens
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgaggtacggagcggacggactggggctgagagctgctcggctctcagctacaggagcggggcggcggggcgtctcgggctgggggtggcagggcggtcggtccgtgccatccgcgcggctggggcagttgcgcgtcggtgcctcccgctgtccttcgtcccacattccgtctccgtcagcgccgccttccccgttccaggccgccctcggctcccttaatcctcagagtgcggcctctccgtcccagacgctagttgccgggatctccagcgccagccgagccccgacggcctgacgcggagcatttcctggccgcctccctctccggcggctcccctcgccccggctcccaccttccgtccaggccgctggctccgaagcagcgtctgtggtcgcacggggcccctcccacaacctccccggaaagcgctggtatgggacgctcggacccagaccacagcccccggccgcggcaggggcgcggggacttgatcccacgtcaccctagggggcagaagtgtcccggagttgggaggggatttgaagcctgtggtcctgacttccaccccgtggctgagggcgaggctgcggggccggggttaggagcagaagtccctgcttccgaaccgtctgggaggagagccgagggatgcccatcacggcagtttagggagagagagggagggactctgccgctttggaggctaggtcataggcagctggcggtgtctcagcgcgggtgaccaatccttgcggttgggaaatgtgtcgtgggcgcccgtgggctcgttttgcctttgagattaggtaggaaattttcccaggacgagtttaccggagcaccttgggagttggtttttggcctggagagctgctttcccccctctaaacctagaactgctttgtttttatttattatttttttcgacatgggatctcacagtgttgcccaggcaggtgtgaaactcctggccttaagtgatcctcccgcctcggcctcccagagtgttgggattataggcgtgagccattgcgcggctttaactgctgttaaagagtgtgttccggccgggtgcggtggctcacgtctgtaatcccagcatttggaaggccaaggcaggcggatcatgacgtcaggagcttgagaccatcctccctaacacggtgaaaccccgtctctactacaaataaaaaaaaaaaagaaaaagaaaatttgccgggcatcgtggcgggcacctgtagtcccagctactctggaggctgaggcaggagaatggcatgaacccgggaggcggaggttgcagtgagccgaaatcgtgccactgcactccagcctgggcgacagagctagactctatctcaaaaaaaaaactaagagtctgttccttaaaattgttgtaccaagaaacttgccagagatgcaagaaaatgtgattatattgttaatatttaatgataaataacattttgcttttaagagtcactgattcatatccgcaggattaagaaatgttcaggatttgaatttttaatgaccttccaagcagtcatgtttctgctctctagaagttagccagttgaggagaagggacagtcaagatactttcaaaacagtgtggtaaggaatgtgagctaagatggagcaccgaggaaggagccgggcatttaggccatgctgttgggtgtggagcctggaagggatcagggaatactttctgcatgtgtcttgaagaatgactaacattcagactaacagggtggagtgagggagaggggggaatcaaaggagaggaggccagtaactacaaggaggtgcctattaatttatttattgagagagagggtctcactttgtcacccaggctggagtacagtgacacgatcacgagtcactgaagtctcaactgcctgtgctgaagtgatcctcccacctcagcctcccgagtagctaagactgcagatgcgtgccaccacacccagctgatttttaaatattttgtaaagatgttgtcttgctgtgttgccctggctgatctcaaactcctgcactcaagcaatcttcctgcctcaagcgtcccaagtgctgaaattacaggcatcagctaccgagcctggagggtcgttactaaagtgaaaaagtgcaggacagagatgtaggagctcaggcttcctctgatggtgacagaaccaggggaagttttttagctgggtccttgtgtggttaaaatgggtctctctggccaggcgcggtggctcacgcctgtaatcccagcactttgggaggccgaggcgggcggatcacgaggtcaggagtttgagaccagcctgagcaacatggtgaaaccccatctctactaaaaacactaaaattagcttggtgtgatggcgcctgccgtaatgctagctactcaggaggctgaggtaggagaattgcttgaacctagcaattctaggaggttgtggtgagccaagattgtaccaatgcactccagcctgggcgacagagcgagacctcgtctcaaaaaaaagaaaaaaatttaaaaaaaaaaaaaaggctctctctctctccctgtctcccaggctggaatgcagtggcaggaacacagctcactgtagcctccaccacccatgcttaagctatcctcttgtctcagcctcccaagtaactgggaccacaggcctgccacctactaatttagcttgcctggctaaatttttttttctttttttgatacggaatctggctctgtcgcccaggctggagtgcagtggcgcgatctcggctcactgcaagctccccctcctgggttcacgccattctcctgcctcagcctcctgaatagctgggactacagatgcccgccaccatgcctggctaattttttctatttttagtagagatgtggtttcactgtgtcagccaggatggtctcaatctcctgacctcgtgatccgccctcctcggcattccaaagtgctgggattacaggtgtgagccaccacacttgggctaaatttttttgtagagatggaatccttgtatgtttcccagggtgctctccaacccctggcctcaagtgattctctagcctcggcctcccaaagtgttgggattacaaacatgagccactgcacccggccctaaaatggaattttatgtaactcttacacacaggctgctatgtagctgataaggataaatgttttcagtgtagtgcttgattatttgcttttttcttttcttttcttttcttttttttttttttaagacggagtcttgatctgtgactgggctggagtgcagtggcatgatcttggccactgcaacctctgcctcctggattcaagcgatttgtgtgcctcagccttctgagtagctgggactgaccatagataggcgcgcgccaccacgcccagctaattactgctatcttgtattttaattttttctgcttattagatgtttgaaatggtggctcacgcctgtaatcctcgcactttgggaggccaaagtgggaggattgcttgaggtcaggggttggagaccagcctgggcaaaatagcaagactgcatctctacaaaaaaaaaaaaaagatagccgggcgcagtggctcacgcctgtaatcccagtactttgggaggctgaggcaggcggatcacgaggtcaggagatcaagaccatcctggctaacacggtgaaaccctgtctctactaaaaatacaaaaaattagctgggcatggtggcaggcgcctgtagtcccagctactcgggaggctgaggcaggagaatggcgtgaacctgggaggtggaacttgcagtgagccgagatggcgccactgcactccagcctgggcgacagagccagactccgtctcaaaaaaaaaaaaaaaaaaaagatgcttgacgtgaatgtatactcatttcctagttgtttctttctataaggatgtctgacctggctaatttgtaaacaggaattctgcattcatttctctctttgctttctcaaccccaattgagcacacaagtgtttaatgagtacttaactgatttgataagaataactcattgatttctttgattttttgttgctggttttcagtgaaaaaaatgttatcagccgcacacggtggctcacgcctgtaatcccagcactttgggaagctgaggcgggtggatcatgaggtcacgagatccagaccatcctggctaacatggtaaaaccccatctctaataaaaatacaaaaaattagccgggcatggttgcaggcgcctgtagtctcagttactcaggaggctgaggcaggagaatggcgtgaacccgggaggcggagcttgcagtgagccgagattgtgccactgcactccagcctgagcgacagagcgagactccatctcaaaaaaaaaaaaaatgatatcagtacttactcattgtgatgtctacatatagaactaaaattctgtttacttatgtgagtctttggctagagacatagaatttcagtcttgactgtgtgagcttaatttctggcatgtgggtttttattggctgcagaggaaacatctctagcagagatgacctatccctcaaatgtaggaaatacctgtgtaaacctaacacctgtgactcagaatagaaatggtaccaagtgagtggcttcttagcccatcagtaaagttatcacaccataggctgggtgcggtggctcacacctgtaatcccaacactttgggaggctgaggtgggcagatcacttaaggccaggagtttgagaccagcctggatcaagatggcaaaactccgtctctactaaaatgcaaaaaacttagccaggcatggtgatgtgcgcctgtgatctcagctactcgggagtctgaggcacaagaatctcttgatcccgggaggcggaaattgcaatgagccgagattgtgccactgcactccagcttgggcaacagagtgagactctatctcaaaaaaaaaaaaaaaaaagtgatcacactaaaaccaagagtttcaggctggtgcagtggctcatgcctataataccagtgctttgggaggccaaagtgggagaatcgcttgagcctaggagttccaggctgcagtgagctgtgatcaagccactgcactacagcctgagtgacagagtgataccctgtctctataaaaagaagtttcatagtacaggccaaacatcttgaaaatcttattaaatgtacacttctttcatagagcactgtagaaacatcatgtgtgttgtttcacatggctgaagtgagtttaaatgatctggactattgttacaatatgtaaacatgtgaaataacagttatcccacttaatattatttaacttatgtttatctctttgatgtttggataaagctcctaaaatgctttaggaaaacattatacttttatggtgctgttttgaagtttcctgtgaaattcctgttttcaatgaagttactgtcagtgggataggaagtgtgattttttttttttacttttctttttttctttttgagacggagtcttgctctgttgcccaggctggagtgcagtggcgcgatcttggctcactgcaacctctgcttcctgggttcaaggattcttctgcctcagcctcccgagtagttaaccaccatacccagctaattttttttgtatttttagtagagacggggtttcaccatattggccaggctgatctcgaactcctgacctcgtgatccacccgcctcggcctcccaaagtgctgcgattacaggcgtgagccaccgtgcccggcaggaagtgcaatttttatttataatataaccttttttttttttttttttttttgagaacagagtcttgctctgtcacccaggctggagtgtggtggcacgatctctactcactgcaacttccacctccccggttcaagcgattcttgtgcctcagccacctgagtagctgggaatatgggctcctgccaccacgtccggctaatttttttttttgctggagtgagactgagtttcagccttgttgcccaggctggagtgcaatagtgcgatcttggcttactacaacctctgcctcctgggttcaagtgattctcctgcctcagcttcccaagtagctggtgttaacaggcacgcgccaccatgctgagctaatttttttatttttagtagagacggggtttcaccatgttggccaggctggtctcgaatttctgacctcaggtgatccacctgccttggcctcccaaagtgctgggattacaggtgtgagctaccgtgcccggccctagtggaacattttaatttgtttctggtagcatagctctcttggcaatggtcattaagagggccaaataccattattatgatcaattaattaaatgtggttaaaagtcagaagttagaataagtatgtgttcatgaatgcgtaaaatattacacactgagagagtattaagctttttaattttcccccagtaacagtgagcagattgctgaaatctctgaagcaggaatgtaacaagagttttgagggctctaaattctctgctgtttcaccctaaggaatggtttggcagcatcctctatgctaggcacagaacaactcaggaggaattgtacaaagaccttatgaaccacatttgaagctagtctgttcagttcccattcaaaataaatacacaactgtaattgaatttatggtgatttggtctgtatgctaaaattaaaaatcgcttttgggggattttcacataggggtatatttataattttctgtgtgctttgcagttaaaaatacatagtgaaagttttatttttgtagttcctctgttgtacagaggaaatttaaattcttaaaattagaattttctaattttaagcactttcatttttcctttagaaggtactttggagcacataaaagaaaatgccattagaaattgaacatagaaaatgtttattaatcgaagaaaatgttttcttattgtgctataatttttttcagtggaacatatcatttacttattccattattccacatcttgttccagaaagggtttgtaatgacttacaaagatacgtgcgacatactgttggtaacataacagataagtgggtgaggaatgcaggactgagggaaaattaagatggaaacaggaatgagctgtgtacacagagcacttggactgaagtcttaagtgcagagggccacaaatttggctttgcttttgagtagccaattaagagagaaatataatcagttacatgggtcagtgaccatacgacaaaagagatcatttctgctttggattcccaaagactttccagcatgcgtttcaaagggctgggtgtcgagttttactttgtgtgttagtaaaactccttattggctttttgtgtaagacggtgacataacatcaaaacattccgtaaaagcatttctcttgcctgcaaaataatgtgatccgagtacttagatctctaggctgatttaaggatctgttttagattatctagatgagtaggtggattgcacattcttcacctaccttccatactttctcagtggatcttttgtaatgaatttatcagcagtggggtttgagtttgtgcttcctcacaagttccttgaatgcatctgttttctgttgttggtgaatcacggaaccatatgttttaacaggcatggtttatcgtgggggtatcacgatggaacagtctgacaagggcacatatttgtttgtttgttttttgaggaaaatcactttattctaattaactcaacaaagaataaaatcataacggctagttcaagggtgccacacaaacatctacccagccatcttaatgaaattctacacagtaagaatttccttttccattgcagtcctgaagcagggacgctatgagagaggagaggtttacctgatgattacactttataccttcactatcaattgtatttttgtgctaaatcacttggttatgagagctgattttccatttctccaattcgaactttctgattagaccaatctgtttgcaagtctgcactgtttcagcaccttattgaaaccctcacagagttttctgtcaccctggttctgggcactctccaaaaactgttttatgtcataagagcaaggccgctgctgctttgctggctgggttccctgaggctcttggtaggtgatatcaggccttcaggctcaccgtgacttcctccactgaagccctggtggtggcatgacccagtgtatgtctgacaggggcacatatttgaatgaaagccacctcacctccatacagagatgggctgagggaataccaaatatgaagatgggagcagatccagatctactcgtctcagatgaaatgtccagtaagttgtattgcctgtattttgctccagctgaacagttgcactttcaagtaataatagttcaaatttatcaaatgctagcaggagccatgcattgtgttaatggagagagaccatccttattcactcttactcagtaaacagtgggtgaaactgcccttgcctaaatatagttatgtaatgctgtgtttccttaattgtatatccataaagcttttgacattgttttctaaatgtgttcctcaaaaaggagttgggctagtgaccaaagttttgaatagaatattgtaagaaagcaaatacaaagtgtaaaaacaaaaaacagaactttgcgaggtgttgttcacctgtagtcccaactacttgggaggctgaggcaggaggattgccggaggtcaggtattagaggctgcagtgcactatgattgtgtctgtaaatagccactacactctagcctgggcaacaaagcaagactccatctctaaaaacaaacaaacaggccaggcacggtggctcacacctgtaatctcagcactttgggaggccaaggcgggcggatcacgaggtcaggagatagagaccatcctggctaacacagttaaaccccgtctctactaaaaatattttaaaaaattagctgggtgtgatggtgggcgcctgtagtcccagctactcgggaggctgaagcaggagaatcgctggaacctgggaggcggagcttgcagtgagccgagatcgcaccactgcactccagcgtgggcgacagagcgagactccatctcaaaaacaaacaaacaaaactacagaataatgaaatagaatgtccaaaatttatcataactggtgtctcacgagataatacgtttgggtcctgtttagcaagttggattatatttttatttgtgtaaatttattggccgttgcagttggggttgtattgagaatgtagattttgtctgatgagagtgtagattttatttgtagtgagtgcatgtggatttttatttgtctagggttttaaaagttgtatagtcatgaatggacactttttaataccatctatgagaaattcaatggcaaagtgttttcatacccatatgctaactgctgatgctttttataaaacattgttaaggtgttacttgccccaggaaatacaatgttttatgacagagacagtactgaaattcagtatttaagttctttaaataccagctatgttgagtagatattactttctcccaagagcctatttttggtttatgacatattagggaacaaattgcagacacagttttttcattacctgtaagagcacttataggatgtaagctatttccttaaagaggaatttttgcctttttaatacttctgtctagtaactcaatgcattaaaagatacatatttttctagtgctataaatatattggtacatttaaatataatatacacacatataatggtgcttgagaaataagttgagattattttaaggttaaggttcttagattctgacagaaaaactgatcagccagttggactacaggtccaaccagttccagccccaaacatgagcaatagtgattatggtagtgattctgccatttacgtcagtgaaatgcaaagatttcagtttcattcttcagcagacgctttatgtgtatttggagaagaatctgagtactagaaaatactcttctcctgtgtttgttctgctgttaaatacacggtttgaattcttaattttagaaatacttttcagatctagaatttcagtttgacacaaattccaattcacagttgaaattcttaatctttttatgttttccctctttttttcttttttttttttttgagacggagtctctcacattgtcgcctaggcgggagtgcagtggtgtgatcttggctcactgcaacctccacctcccaggttcaagcaattctcctgcctcagcctcctgagtagctggaattacagacgtgcgccaccgcacctggctaatttttgtatttttagtagagacggggtttcaccgtgttagccaggctggtctcgatctcctgacctcaggtgatccgcctgcctcggcctcccaaagtgttggcattacaggcgtgagccaccgtacctggccttccctctttttttctgtttttaaaaacataccattaaataagtctttctggtaaaatcaagtataaatcatctgagcatctgtttctattatctgcgtttcctgttggtttttagttatctgaatgtgagacatcgtgaatacagtaagggtctggatgatgctatttttcagagaagaaatcactcttccttttgctaggcaggtagagtggggctgatcacctaatactgctagagactgagctgagggttgaggttgtgttgcaggttggataaggccgcattttgctctgatttgcccttactcctagcaggtacccacctaagactttcagctgatagtctgggagtttataggagtccctccccgacagaggttttatactgtcatatttgtctcttgagaacaatgagattgctgaaaatttcactcttgattttcagaggcttttagttttgttttgaagccttccctgtgtggctatagaatttggattgtgtcttcaggggaaaaccagcctcctccccggatctttgactcctatttcactgggcccttgagtcccaaaagtcaaaatcttaggctgggcacattggctcacacctgtaatcccagcactttgggaagccaaggtgggaggctcacttgagcccaggacttcaagaccagcctgggcaacaaagaccccatctatataaacaaaccaaaaaaaacccgcaaaaaactagccaggtgttgtggcttgaactcagctactcaggaggctgaggctcaagattgcttgaggccagacgtttgaggctacagtgagccatgattgtgccactgcattccagcctgagtgacagactctgtcccaattaaaaaaaaaaagtcttggctgggcgaggtggctcacgcctgtaatctcagcgctttgggagtccgaggtggacggatcacaacaaggtcaggagttcgagcccagcctggccaacatggtgaaaccctgtctctactaaaaatacaaaaattagccaggtatggtggcgggcacctgtaatcccagctactgggaggctgaggcaggagaatcacttgaaaccagaaggtggaggttgcagtgagccgagatcatgccactgcactccagcctggggaacaagagtgaaactccgtctaaaaaaaaaaaaaaagtcttgatttttgtctcttccaaaagctctctcatggttcctcatattcagaaaagggagtctcccattgggaatgaagtcctgagaataaatggacattttcgtaattgtggtgttttctttatagcagtggttctcaaaggtagttcctagcagtatcacctggaaacttgttaaattcgaattctcaggccctttcccaggccagttgaatcagaaactctggggtgggacccagtactctgtgttttaactagtcttccaagtgatattgatgtacattcaagtctgagaaacactgcttgtcaggttagttgtttgctgtttaatttttttactcccaccttcactgggccctggagagtgtggaagggacaaaagtgagagaacactgtctctgcaggtactttgccagtcttctgatgaattgtttgagaaacctagaaaacatctattgagcacctcctcagttcctggcactgtgctaagtggctaagagcatggggtggacatgtaagcaagtaattgtaataggacatgagtattataatggctgtatttataaaaagctacaggaacgggagagagaattaccctgtcagtggggaagttggagtcagatgtcccttgatccttgaacagggtaggatttgaaggtgaacagacagaagggtattctaagtgggttcataaataggatgaccatgtaacttattatccacaggtggtcacttttgagaatcaaagggggtgcttttaggccaggactgttgcttgctaactggggtgtatgattgtcctatttgtaaagaacaggtgttgctgtgaacccagagttcgatgtaaatttgtggaaaactcatttcttctaattatttgtagagtttacaacaattcttattggatggtatatttttcccccagggctgctgtaaaatattacaggcatactttggagatattacgggtttggttctgcaccactgtaataaagtgagtcacacaaatttttgtgttacccagtggatataaaagttgtattttgggccagggtctctctgcatctctgtgttccagttggggtagggtaatttccctttcagtttgaagagctctccctggtatttcttccagtggatgtcttcgcataacagtgttttttctctcatctgaaaatgtctattttgccatcgtttttttttttttttttttttttgagacagagtctcacactgtcacctgggctggtgtgcagtggcacgatcttggctcgctgcaacctctgcctcccgggttcaagcaattctcctacctcagtctcctgtgtagctgggactacaggcatgcgccatcatgcctggctaatttttgtatttttagtagagatggggttttactgtgttggccaggctgttcttgaactcctgaccttgtgatccacctgcctctgcctcccaaagtgctgggattacaggcatgagccaacgtactaggccatttttttttttttttgagacagagtcttgctctgttgcccaggctggagtgctgtggcgcaatcttggcttactgcaacggctgcttcctgggttcaagcgattctcctgcctcacctcccgcgtagctgggactacaggcgccctccaacacgcctggctaatttttttgtatttttagtagagacggggtttcactatgttagccaggacagtctcgatctcctgacctcatgatctgcccaccttggcctcccaaagtgctgggattacaggcctgagccactgtgccaggcctttgccatcagtttttaaaggaaatagtcactgagcactggatgctaggtggcaggttttttctttcagctttttttttttttttaaagccatcatactttaatatctttcagcactgtcaggttatcttctggcttctattatttctgttgagaatttagcccaggcatgggggcttatacccgtaatcccagcactttggaaggccacagtgggcagatcacgtgagcccaggagttggagaccagcctggccaacagggtgagaccttgtagctacatgtggtagccctttttcagtacattggccagtccagctcagctggatgtcatttacatatgtgtcttatattttagatacaaaagacttcttaaaagcttagagcataacacaaatatttatttgattgcgccatctaacaaatctgaataaatacatttcacgtctaggcattgcgttttgtatttctctaaaccagtgtgggcgtgtgtgtatgtgtgtatcactttacccagccacagcaagtgattatggatgaaatggctacagcaaagctaaaactatgatatgcctttgagaaaaaagttctgagctgagtgcattgtctcatggctgtaatcccagcactttgggtggcaaaccatgggaggattgcttgaggccaggagttcgagaccagcctgggaaatatagctagatcctgtctctgttggccaggcacggtggctcacacctgtaatcccagcactttgggaggccaaggcaggcggatcacgaggtcaggatattgagaccatcctggctaacacagtaaaacctggtctctactaaaaatacaaaaaattagctgggcgtggtggcaggtgcctgtagtcccagctcctctggaggctgaggcaggagaatggtgtgaacttgggaggcggagcttgcagtgagctgagattgcatcactgcactccagcctgggcaacagagtgagactctgtctcaaaaaaaaaacaaaaaacaaaaaacaaaaaatttagccagggatggtgatgcacacctgtagtcccagctacttgggaagctaaggtggagaggatcacttgagcctgggcagtcatggctacagtgagctgtgatcatgccactgcactctagcctgggttatagagccagatcctatgtcaagaaaagaaaagaaaaaaaaagcgtaaagaaaagaaatgcctttaacagagaccacctaatatgttgcaagttgctgttaccttaggtggagttaggagaaataatttttggtcagtaacttagtgaataaattgaccatttgtgctgcttccctgggcgagggcatagagaatggtacaaagtaggctacggtagccagattatcttgtatgtaattttgagctgttattccggagaatggcatgctcagattagagttacaattttgcttaaccaaggagagcgtgatctagtacaatagaagactgttgtctagaactcattccttgagaatgctcccctgcttgctctgctcattccagcagcaatcaactctacattgtattccagggagttgattatcatttggaattatttgtccaagctaacgtttggacaaataatgttttgttatatttaacattaaaactctgacattgacattcacattcattttggaagcattatatttaatcatatgaaagttggtgaaccttggattacagattgcaaatgctaataagtcttttattagaatgatggcgtcttcataccatgaaggtgagtactgaaagatatataagaagaatatctataaatcaaaagaaaatagtaatgacatagaaaaatgagcaaaatcagttattcaaagaaaatatactagtgctaataaatatctctaaagatggctaaccttagggaaatgcacgttaaatgattttttttgtttgcctgtcagattgacaaaaaattaaagttcgataatgctatgcttatgaggttatgggagaccagattccctcatacactgtaggtgggaatgtaaatggtatagcctttttgtcagaccagtttggtatatgtcagaattttaaatgcacataccctttggcattccgtttctgtttctagcaaactgctcacattttgcggtctgctcaaggtcatggtctgctcataaccttgtcctgcttggctatcaaagatttataaattgtgttagtactatttctgaatttaataaaatacttcattgtcctgttcagatttttttttctagtcccttatttgcttttatattttggctacagatagcctcttaaaaactagctagatgtttcagtttatgtattttaagttttgtttcctttctgactttccctgcagtttgtaaccttagatgacactcatctctttagaactttcatgaatacttcattttagttctttccattttctgtttgtctctaaaatctttaactttttaaagatacctgtaattaatgtagggggtgtcagattgctgaccagttattgcaacactatttattgaaaatttccccttcccctccttcttctaacattaaattaccttatatattacattagattcatttttgagtcagtgtatcctgtagtggtttgacaggtctgttcttgtgttcacagtcttctaactagtttgcaaataaaaattcagaaaattaatttagaaaatcaaaaaataattgagtctgtttatttttgctgacattcattttgttgagttccaaaaagtcttgtgggatttttatggccatttgtagtaaacttacacattttggaatgtttgacactgttacaacatttattttcacacattatgttaagtatatttccatatttttatgtggattatattttctcattaaaatgtttttctacaagtgtttacatattgatgctattatgactgatatcttttttatactttctaacttgttattgtttctctgttacaagagttccacagatttcatgtacctatctagcttatttcacataaatgtgaattcttttttaaagttagccattttaaagttaatttctcagcattaatagtgttttattttctttaggcctttcagatacatagtcatatctctcatattacacactaagctccgcaatgactgaaatgatttatttttacttacatttgtatcccaagtgcctttcgtgcagtaatcaatcagtatataaatatttgaatgaatgcagagggaacactataggaatatgtaccatatacagtaactgcctctggatgatgactaaaactttttttctttttgagatggagtctcgctctgccgcccaggctggagtgcagtggcatgatctcggctcactgcaagctccgcctgccaggttcatgccattctcctgcctcagcctcctgagtagctgggactacaggcgcctgccaccatgcccggctaactttttgtatttttagtagagacggggtttcaccgtgttagccaggatggtctcgatcttctgacctcgtgatccgcccgcctcgacctcccaaagtgctgggattacaggcgtgagccactgcgcccggccgaccaaaacatttttttttgcttgtctgtatatatcaggttttgtaaataatgagtattccattattttctaactggaaaaaaaatttaagggaaaaaaatcacccgtaagttttatttcttaactgaggtcaaaggataccttatcgttttactagaattgattggatgtttcctgtaagtcccagatgagttgcctggagagaggaatgacctctgagggcatgacattgaacccaggaataggaagcggaccgccaagaaggatagagggaaactactcacatctgcaaagtattttcgttttgcttttctgagacgaaactggtttgcatccagagccttaagaaagaacactaatagttctgtgagctttgtaagtaagctttgtacctctctgtcctttttagggtacctggacctagaataaaacctagcgccgaggcacaatttacagaatcctaactgtcccagcagcagagatcatttttactctgtcttccctgacataagtgggaccaattgaattgtgcattctttatgcccaggttgctcaaccaagcttctatttattggaatgcagtgctccaacaggagcgatgtgtggcccctcggagctccctcctggaagcagtgctggtggtggttactgtctagggacaggtctgtctgcccaggagagaaggagttgagtctcacgcagctgatcccccatgtttcttcctgtgtttacaggatatgctgtctgtagctgtgatgtccaatctgggtgtgccgactctcctgccttctaccgtaacagctgtcaccaccaccacatagcctttcaaatgatggcactctcttttggtggtacccttgctctctttttatacttagaagcagcagaatgatctgagtgttgtgtttaactggtacacattagtcccatgataggtgttatttttattaaaaaacgttcatgtgtgatttttaactaaactttaaaatttggaacaattaatgacttcaaatccataggaagctgtaaatacagtacagacaggtcctgtgtactcttctagtttgcctaatggttacatgttacataactataatgtaatgtcaaaaccaggaaattgatatttgtgcaatgtatgtgtatagtgtcatgcacatttcatctcatacgtagattcctgtagccaccaccatagtcaagatacagaactattccattaccccaaagacttcccttatgactctgtagtcacatcctgtgtcagcagtccccagggctgcccccaggtttcgtaattcgttcgaggctctcacaggacatatttattccttgctatggtttgttacagtgaggggatacaaagtaggattaataaaggttagttgtgcattgagcagattctacaggacaccagcattgttaagattcgaagcgtcttctcccagcagagttgcccaggatgtgcttacttccccagccgtaaactctagcaacatgtgtgaagtgttttttattgtgaaagctcatgtacacctcagaatccagggcttttactggaggttggtcacatagtatattagttcgttcattctcacgtagttataaagaaatacctgagattgagtaatttataaagaaaggaggtttaattggctcacagttctacaggctgtacaggaaacattgcagcttctgcttctagggtggcctcaggaagcttccagtaatagtggagagcaaagggggagcaaagtgtctcccctagtgggagcaggagcaagagagaaggtgctatacacgtttaaacaaccagatctcacaagcacagaaccacaggggatggtgcgaaaccattcatgattaactgccccatgatcagatcacctttcacaggccccacttccaacattggggattacaattcagcatgacatttgggtggggacacagttccaaaccatatcacataggcatatagtccctttaaaactgatcaccgttacagcaactccagaaggaaatcaggtgtttaccataaatcatacagtttgcacaaaatatctagacaagctggacagtgtggttcagtaccgtaaccatacaaaacacccttatcatatagagcatagggctagtacaagacctcagtttctaggagctgaccaagggccagtctaacccagctgaccaagcaggcccgtctgagaatgtgcatcatttgagcaactcaggcctgctgggttaactgcttacaccattttccttcccctcctcttccttgccttcgacactcttaacctggaaaaagcactaatttgtcctccatatctgtggttttgtcatttggaaaggttgtagaaatcctagagtatgtgaccttttaagatgcactttttagaaaactcaacatgttgctcttgtgttaatagtttgttctttttagtgttcggtattctcttgtgtggtcatgccccagtttatttaaccatcccatagatgtttattttcccttgtaaagttggttagcatgtattttttttttttttttttggagacagagtctcgctctattgcctaggctggagtgcaatggcacggcctcacttcatcacaacctcttcctcccgggttcaagtgattctcctgcctcagcctcctgaggaactgggactacaggtgcatgccatcatgcccggctaatttttgtatttttaatagagatggagtttcactgtgttggccagcctggtctcaaactcctgaccatgtgatctgcccgtctcagcctcccaaagtgctgggattacaggcatgagccaccgcacccagccagcatttataattttaacataatggctaatactcacgaggggaagagatttttgaacatttttaaataatagagacagagtcttgctgtgttgcccaggctggtcttgaacgcttgactttgagccatcctcccaccttcgcctcccaaagtgctgggattgtaggcgtgaaccattgcacctggccctggggaagggatttttgtatttattaagcgtttagtacgtatcattgctttatagccctgttattctatggtctctacaataaccttattcatttagtttttcttctttcaacaaagaattgagaacctgtgatatgcccagttgtgcagggaacaaaacccctcaaactgtgtttttcctctgctcacgccacaggaatcatcaacacagaagacttccatgaccatatgtgttgggtttcttcccctacacaccacaccagctgggtgtcttctagttcacttcctgcactatctaccaggagatagtgtcagatcacacagggtgaggactcagtccccatgagtgcccctcctaacccccatcagttgcaactctgggcctccagaagttctaactgaccagcttcaagttggggttcccatggctccctttttaggttcaattaatttgctgaggtggtttacagaactcagggagatgcttctgtttactggtttattataacagatattgcaaaggatccaggtaaaggagatgctgggggcgaggaatgggggaaggtgcagaacttccatgccttccctgggtgcacaccctccaggaacctgcactgtgttcagctgtctgaaagcttcctgggcccagttctcttgggtttttatggaggcttcctgacaccagcattcgtccctcagagtacagagctggaccctctctggggagggtttaagaccaatccagaatagagtcctgccttggggcaggtaaaaggagggtaggagaaagagaggctgcccatgaagcctaacacacccagccttttaacaaaagcctgggggtgggcgtggtgtctcatgcctgtaatcccgcactttgggagtttgaggtaggcaggtcacttgacgtcaggagttcgagagcagcctggccaacatggtgaaaccccatctctacctaaaatacaaaaattagctgggcatggtggcaggcacctatagtaccagttacttgggaagccgaggcaggagaatcacttgaacccgggaggtagcgaaggttgcagtgagctgagacctcaccactgcactccagcttgggcaacagagcgagaccctgtctcaaaaaaaaacaaaaaaacaaaaacaaaaacataaaatcctaggatgagggctatggtagttaccagccagggactgtggacgaaaaccaatatatattataacaccacactggtactatttgagtcactagaaatgtaacagtggagaaggaaaataaggtctctgtcctcagcaaattgcattctggcagtgagggagacagaccaatgggtaaataagtaaataaaaaatatttattagaaataggacatggaggctgggtgcagtggctcatgcctataatcccagcactttgggaggccaaggtgggtggatcacttgaggccaggaattcgagatcagcctggtcaatatggcgaaaccctgtctctacaaaaaatacaaaacttagccaggcatggtgccacatgctatagtcccagctactcaagaggctgagacgagagggtcgcttgagcctggggaggtcgagtgttgtgagccatgatcacaccactgcactctagtctaggtgacagggtgagaccctgtctcaagaaaagaaaagaaaaaaagaaaaaaaagaaataggacatgaaggctgggcatggtggctcacatctgtaagaagttcaaggccagcctgggccaggtggtaagaacacgcctctaccctctcctgccacccccgtcccccaaaagaataataataaataggacatggagaaatggcattgggtccaatacggagatgagggttgggtaggctggggtaggtagtatttcacagaggctagtgaaggcctctcacagtctgatgtgaaagcttagacctaaacgatgagaaacaaaccaccacctggacagcaagggccacagcattcctcactttggaatagcatgtgcaaaggctctcccaacaaaggggtaagtgggaaggatagcagtttaaaacactcatttattttttatttttatttttttaagagacaaggtctctgttgcccatgctggagttcagtggtgcagtcatagctcgctgcagcctcaaattcccagcctcaatcagtcgtcctacttcagccttcctaagtgctgggaatacaggcgtgagccattgcccctagtccacagcactcatttattatctgaaagttctgtagattagaggttcaagcaggctccgctgggtattctgctgaggacctcaggaggtcagaattaagcatcggccagcctgggtttttatttggaggtgatagagagagtctccttccagatgcactcgtgttggcagaattcattttcatgtggtgaaggtctgaggtcctcatttctttgttggctgtcagccagaagtcattctcagcttctagaagccactcaaatttcttggctattagtctcctccagcttcaaaaccatcaatagtgctttgactctctctaacttcacattctgtctcttctgttttttaaaaagacagctttattgaggtataattcacataccatagaattctcccttttgaagtgcacacttaagtgacagccattaccacagccaactttagaacattttcatcatctcaaaaaggaacccatgccctttctcttatccctcttagtgctcagtgaccactactctattttctgtctctagatttccctggtatggatgttcagatgaatggaatcatataatgtgtggtgttctataactggcatctctcacttagcatgttttcagggttcaccatgttgtagcatatatcagcacttcattcctttttatgaccaagtaatattccattttatggatataccacattttgtttattaattcatcagttgatgtacatttgggttgtttctgctcttggactattatggataatgctgatataaacattcacgtacaagtttctctgtggacacatgtttttatttctcttagtctaggagtgaaattgctggtttctatggtaatattgtttaatcatttgagaaactgccagacttctccacaatggctgtaccattttacattcctacaaacagtatatgagggttccagtttccccacattcttggcaacacttgttatttctgactttttggttctagtcatcctactggatgtgaagtggcatctcattgtggtttcgttttgcacttccttgatgactgatgatgtggaacatcttttcatatactcacgactgtttgcatatctttctggagaaatgtccattcagatcttttacctgctaaaaaaaattgttaatttttattgagttgtaagaattttttatatattctggatacaagttccttattacataaatgacttgcaaatgttttctcttattctgtgggttctgttttcatttgataaggtcctctgaagcacaaacattaaaattttgttggagtacaatttatctgtcttttgttgctcctgcttttggtgccatatctaaacatcctttgtcaaatccaatatcatgaaaattttacctctacattttcttctgagagctttagttttagcttttacatttaggtctttgattgattctgagttagtttttgtacgtggtatgaagtaagcatctaacatctaacatcgttcttttgcatgtggctatccaattttcccggcactatttggtgaaaagactcttcttttctccattgagtagtcttggtacttttatggaaaatcagttgacagaagacgtatgggtttatttctggaatctcaattctattccgttgatttctatgactttccttgtgccagtaccgcgctgtagtaattaccatggctttgtagtaagttttgaaattaggaaatgtcagttttcttacattctttttcagtattgttttggccattctgggcccttgttatcttctgcattttagagttcatgtgctttcattgggcccatctagatatctagcatagtctccttattttaatgattagtcaacttaattatatctgcaaagtcctttttgcagtgtaaggtgacataatcacaggtgtagcaccagagagtgaaggtcatgggtgcacaggtcctatgaggcttagttgggtgaaaaggtggagaatgataggagcagagaggttggagagggatataggaaagggagtttcagaaatattacatagtttgcctaaagttacatttccagtacgtggcagagctggggttggagtgcagataggactgatctctgtgatttcatggtccacaccaaatcagtcttcttagactcagagctattgttattgtttctgtctaatacatagtgagcttttattgtatgccaagtaatccacagagcactcctttatgtttttctagctcttaaagagcatctgtacaagtcttttggcatagataataggctctactggaaccagcttaagaaaaaacgacaaaagtagttaggggaccagggtgtatgactcagaatctgaggatgggcgtgcacgtaaaccttagccagggattggaactgggagattgaaatcattcaggacgtacaggaccttctacttttctctgcttcttggggtatgtctatttcattctgtagactgtcctgatactcagaccacttgatagaaggatcatgtcacacagctccatcattcaagagaacagccccgacttagtcccatttccaaaactcgaagcaaaagactctaacacagttggaggcaatcagctgtgatcctgaattgggggaccattcaccttatacaaatatagctgctgccagcttatctttgtggattgagaggacagtttcctgataacatgggaggttatgtgctaggcagacttcccaaactatgttcattttagtaacattgagtagtactatcatacttatagtacaaaatttaaaaaaacttaattgatctatacttaaaaataggtatcttccttttgcccatttctcttggaagggaagaaaagggacatcaggatgataatggcaagattagctcagactttcaaaataatttgaaacccaggacttggcatactaagtataggcttacttgagctcaggagttcaagaccacctgggtaacgtggcgaaacaccgcctctacaaaaaaataacaacaattagccaggcatggtggctgagtggtggagtattgcttgagctcgggaagtcaaggctgcagtgagctgtgatcacgccactgcactctagcctgaatgacagaccctgtcttccaaaaaaaaaaaaaaaggaagcttagtgcttagtgatgtctctgccacttactacctttttgatggaataagtcatgatttcttaatgttagtatctttatctcttactataggatgtagtagatggtctttaaaaacattctaggactctattcttttctttttttctacttgttattttcttgctttctacctcagccttatctactatttataaatggctggtgtcttagatctaaatcctgaccttggagggctttaaccttgtagaggaagtaaacagtaaacttgagagttttttctaattagatttccctctctctgtcaagtctcattaaataactattaaagatctgatctctaaggtagattaccacccgtcgtctttccattcccactgttacctcttatttatttatttatttatttatttattttcgagacagggtttcactctgttgcgcaggctggagtgcagtggtgcgatctcggcttactgcagcctctgcctcccaggtccaagcgattcttgtgcctcagcctcctgagtacctgggattacaggcaagcgccaccatgcctggctacccactgtgttacctcaagtcctctaattgtagttgtctcttggtcagtatctgtgtcttctgttctgtacttctccctaatccaacctggaaattgcctgtcaagtttcttttttttttttttttttttgagatggcgtctccctctgttgcccaggctggagtgcaatggcatgatcttggctcactgcaacctccatctccccggttcatgcgattcttgtgtctcagcctcccaagtagctgggattacagacgtctgccaccatgctcagctaatttttgtatgtttaatagagacgaggttttgccatgttggccaggctggtctcaaactcctgccctcaggtgatccacccgcctcagcctcccaaagtgctgggattataggtgtgagccactgtgcccagccgaggttttttttttgtttaaatcatagagtaaaattgatctgggaggagtataatggtctgcgaatttttaaattttattagatttatgtaaacacctccacaatcagaatacagaacagtttcatcaccccaaaaaactttctcgtgctaatcctttatagtcacattctttcctacccctagttcctaaatggaatcatatagtatgtaaacttttaagatggctgctatggtctgaatctttgtctgtcccccaaattcatatgttgaaattctaaaccacaaggtgttgctactaggaggtggagcctttgggaggtgattagttcatgaaagtggagacctcatgactggggcttgtaagtgcccttataagagactgcagagagcctagcctgtctccccctcccaccatgtgaggacacagggagaaggtatcttcattgaaccaccagacaccaacatctgttgacttcctgatcttgaacttgccagcttcctgcactgtgagaaataaatttctgttttttataacctacccagtttatggtattttgttactgcagccagaaggaactaagatgctggcttctatcagcataaagcctttgagattcatcaaagttgttgggtgtactgatacctgttgttgttgttttcctgagtagcattctgttgtatgggtgcaccatagtttgtttattcattcacccattgaaggatattttagttgtcattttttgtcatcacaaatattgctactataaccgtttgcgtatagaattttgtaaatagcaatttttatttctctagaggaaatacccaggagagggattgcaagcaaacgtttcaaacctttgatgtgaagggagacattatatttactgtactggacagttaacaaattgtcttctgctgtggaaggagctgtcgtctttctcttgtaaggatgttcaatatacaaacatccttgactgcacagtatgtagcaaaggcctctcatggaaatgtgggacaccagtgtatatatcttctttgttaaagtgtctgttgaggttttttgctcatttttaaattgggtggtttgttttctgacatctgagttttgagagttctttatacattctgggtatgtaagttctttgccaaatatgtgatttgctgcaagtagtttctcccattctgtagcttgtctttttgttttctaaacagttattcccagagcaaaatgttttgttttgttgccagatttgggatgcaggttctgtgggctgtggctttaatgtcagttcattgttcagagttttgtagtgctgtttccatctgtttcatatatgtgctgatctgagacctgcatagtggtctctccattagttccaatttggaagcctttggtacggaatagcgtcagatccatgcatatgcagcctaggggtaagcctagaaattgctttcttgagttctcctcagcaatttttcccacactttttgttctcaaagggctcatattttctttcttttgtccagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatggtaagtggggggatccccatattctctctggctgttaggagttccctttcacatggctggagcccaaactagaggagctttctctgtgctgtggggcccatttccaggttggctggtggtattggttggaagaaagtggtaatctcttagacagctgggtgatacttccaattctggtcttccccacttctccattttgcttttcagaatcctcaaaaatagtgcacagtgcatactgtccagatttgatagctggatgaaatctgtgaggcctctctccccagcaactgcagtcgctgtgctcagtttttcttccttgttttcatttatgcctgacttccttctagctgtcacccgtgtgtctgcacaccttaatgttcagccaaagattgttgtttcagacaaagattgagattgcgctcaaacatctcaatctttagttaggcttccactctgatcagcagagcatgtgcatacacagaggagacacaggagaaccttgtaaaaataagagtgaggttagaggggagggcttgaaatttgagttcattccttggcctggacgtagatgcattgcagaaagtggaagttttgtccatctttacagttgcttttgcaggagaggatttattttccttctcacttagtcatgctagaagacagaactctacatctcaagttttatgtcttaagatagagatcttatcatgctttccccttttcaggagctttcagtggtgactttcaatccagactctgtagcttagagttttaaaaagccatcatgatttgacttcccacctaagttgtttagtttaccttctgtctgtgctacatcattcatattttacacttgccttcttgcttctgagctttttgtgaaaggcatccttcctgtccagaatgccctccctctttctgtcatccttccaagaccctttcaacacaaggctctttaaggtctatcgccagcatccccaagtggtctctctatactccgtaagtgagaattcctatgtctgttgctccctaacagtttcctaacactttctctttttctgcgtttttcagtctgcctgtacttttggttatgagcttcatgagggtaaggacatgttctatgagttgcatcaccagtgccatctagctcaattctctgcacacagttggcacttagtaaatgtttgagttaaattaataagatccccaagatatagggcttaattttatctgcacatgtgagtcttcttgaatgaatggtgtggagtgctgctttttttctgtgcttgtttggcagtttgtttatatggagaagaatgaagaccatgtggtttcagtttgaacggaaattgttgcatagcgatttaccatacagctgtgagactgaacaaatgagtttaaatattatacagtagaaaagaaaactgactttggaacttaaggtattatttcaatttttttctcttctcttctctctagacaaggcctcgctctgtcacccaggctggagtgcagtggtgtgatcatacctcactgcagcctccaactcctgggctcaggcaatccttctgtctcagcctcccgattagctgggactacaggcatacaccatcactcccagctagttgttgtgttttttgtagagatgggatcttgctgtgttgcccaggctggtcctgaactcctagcctcaagtgatcctcccaccttggcctcccaaagtgctgggattacaggcatgagccattatgcccagcctgggtttgtttttttttacagtagccatcctaatgggtgtaaagtgatatctcattgtgattttgatttgcatttccctgatgattagtgatgttgagcatttttcacatttgttggctgttggtatgtctttggagaattgtttattgaagtccttttcccatttgttaatcggattatttgggtttgttgttgttgttgttgttgttgttattgagttgtaggagttccttcgtattttagatattaaccccttattagatatatggtttgcagataagttctcccattctgtgtgttgttcctttttaccctgtcagttggttcctgtgttttgcagatatttaatttttaaaaattttttatttcttttgagacagagtcttgctctgtcacccagcctggagtgcagtggcgtgatcttggctcactgcaggctctgcctcccaggttcacgtgattctcctgcctcagcctcctgaatagctgggactacaggcgcccgccaccacgcctggctaatttttttgtatttttagtagagacagggtttcaccgtgttagccaggatactctcaatctcctgattttgttatccgccctcctcagcctcccaaagggctgggattacaggtgtgagccaccacaccggcctgtgcagacattttaaagtttgatataatgtatttgtctgattttgcttttgttgcctgtgcttttggtgtcatatcctagaagtcattgcaaaatccagtgtcgggaagcttttcccctaagttttttttctaggagttttctagtttgcagcctttacatttaggtctttaatctaatgtgagtcctttcttaattttttattttttattttttattttgggcagggaataagtctttctttaatatggctgtgtcaggaatttactatatttaacattcttttttcttccttcctcctctttctccctccctccttcattccctccatccctctcttaacagcttgaagataatggaatcactcactttttgttcataattggtaagattttatttagtagaatgataattcattttcaacagcactttcttgtttgttcagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcggtaaaaggacttaactaggggcggttgaacagtgacgtgactggatacatagttctgtcaccgtctaaatacattttttcacttctgctttgagctatcagcaagtcagtttaatattaaggaaaaggatgttttcctctcttcttctcagtcagcttttaatgaacagctttcagtagtttcttcattttgtgtttgtcttctgattattttctttgggttgtgttagttttagttctcaaatgtagacaataagctccttggagtggaagaatggagataggcatatttcctggtgaagattaaatgagctaataaatttgacgtacccactgcagggcttggaaatggcactcatcaagcattatttccctcattcttttaatatatatttagcatggcatctagctcagtgataaaacacagtagtagaaatctgttgacttgtatacatagtcattgcattgtagaaatttaacttatatttaaaaattaggttagcatttggtattatccggaaatataatgatgttaaaaattaaacgatgggccgggcgcagtggctcacgcctgtaatcctagcactttgggagggtgaggcaggaggatcatctgaggtcaggagttcgagaccagcctgaccaacatggtgaaaccccctctctactaaaaatattaaaaaagttagccgggcatggtggtacgcatttgttatcccagctacttgggagactgaggcaggagaattgcttgaacccaggtatcggaggttgcagtgagctgagatcatgccactgcactccagcttgggagacagagtgagactctgtctcaaaaaaaaataaataaataaataaataaatgatgggatggctagtgagcataggaactaataaaatgccatgaataatgttaattctttgccagagcattctagaattctaaaactgcttcaacagaagaaagtcaaatggaattctgccaactcctctagctagttgtttgttttttttttttcatccagtcagccaatatttgttgagtgactcctttgctgtcatttgtagtgaactcagagaattagaaattacacattgctttcagtgactgtgttcaatcaaagagagaaaattttagccgagaacatgaatgatctcctcagggtttccactgcatgcctgatgctgtcagtagcagatcctgtttcaaaaacagagtagaggccactaggcacaaactccctcagcttcctcccctcaccacataaaaatgtcctagtacctttatattaacttcttgtctgtcccagagaaagaggggtcccgattccaccctcagacttagcacctccacctgtgatttttgtttctatttcttactgcttttaattgtgaccctgctaaatctctcggaaagcttgtaaaagcagtgattgctggaccttacccacagagtctctgattttagtggcttgggagtaagactagagaatttgcatttctgacaagttgcctggtgatgctgcgctgctgtctggggaatcatacttggaaaatcattgtcttttagatagtgcttgtgctttttgtttgtttgtttgtttttgagacagggtcttgctctgttaccctggctggagtgcaatggtgcaatttcaacttactgcaacctctgcttcctgggctcaagtgatcctcctgcttcagcctcccaagtagctaggactacagaagtatgccaccatgcccagctaagttttgtattttatgtagagacagggtttcaccatgttgcccaggctggtctcaaattcctgagctcaagtgatccggccgccttggcctcccagtgtgctgggattacaggcgtgagccactgcacctggcctgtgtttgggaattaatacaggtggttcacatgcagctaatccaaagccaaatttattgcttttatttattattctccgcattctgaacattttcctcctaacccttctcctgagtcaattaatggcatcactacttaccaagttagctaaaaaaccttggtttcattcttgatttctcttttatctcccatgctagctacaacttgaccaagttctatttcttccaactcagaaaagtcttttgaattttaccttttgtactcctattttccaggtgcttattttcttttacttaaacctttataatatactcttacttcttgttcctgtctctagtttctctacccttcaagttgttcacacagctacctgcatgatctttctaaagtacagatctgacagcgataactccttggatttacagtctttcttgcttccctaccacatgatgaaatccagaatagtgggctcagcaatcaagattccctaccctctggagccttcctgtatatccagcatcacagttcatcacacgcccagtgctctggctacattcagcttgttgtgaagcaaaccacaggcttgcacatttgtagttccttctttctggaatgtcctttcacttagaatcctattcagccttattagtcaggtgtggtggtgtgcgcctgtagtcccaataacttgggaggctgagggatgagaattgcttgaactcgggaggcagaggttgtagtgagctgataccatgctattacactccagcctgggcgatggagtgacactctgtctcaaaaacaaccaaaaaaaggatcctatttatcctttaagacctcacccaaacatcaccgttgtaaagcctcgtcagactcccccagcagattgagttgttctttcctgtgttctcacagcactcaacttttactctctgatgtagcagctgtcccattctgtagcagttgtttacttacctttttgtctgttccagccttgagcttgttagggaaaaggattagacttgatttctttcatgtaaccctagagcagtagctgaatgagtatgagaagaccccatttgaaatctgtagtgcatgaagagccgtccatcctgtagcaatgtgagacctcagactgatttggcatatttagtctctaggtctaaaatctttagatcctcctgaattaatggagtaataaccttcacatacagagaaaccttggagaatatctaggtcattctaatcctctcttgaattgcagactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaagggtaatgttctgatactcttttttttcttctctgcctgagtgagacacagaggagatccccaatgctcataagctcagctttgtaatttctgtcaactttttgagaacatcagctcagatttgacactgaaattgggcttgagggtcagacagtatatgaaatcaatactctctttggttgaaagacattgtgttttagagaaatttgtttataggaggaatcaagagaattgaaataggtacttttgcttatgaaattcatccccatccaaatgactatctctttggatgttttggtttttgtgcctttatttgtggatcctggtttgttctgtggtataataccctcactgttcatagcttgtcagaaatggtgatttctaggcttgatagtcatctgagagagagattttctgcctgagagcttatttgagagacagcttgtgtcttgaggaagtgtattgagaacatataggaaaaggcccaagttgggctcttggggggatgaaagtgagccatagtagctattttccagtgcatggatttgtatgtaggtgatcatattcaccctgctttttaaaatgccatataaccagcaagaggattgtcacttaagtcacagttgttctaccattgagcagactagctagttgaagtggcccaacatgaagcaagaaagactctttgttgttaggcctcagtctgtctttgaaaatttatgttggtactcagagttatgcagtcaaagcgaaataatgagggagactgggaaccaacactgatgctgtcagaagacctgttctctgggagccccctcacttgctccccagttcctaccctggggtaattgtaatgaggtctcccctgaaggccggggaatgaataataagacagtgttacttcttaagatacttgctggtcttctaggttttgtgacttttgctgtttccttttgttttattaaaaggaaatattgctcataaccaaaaacacacctctctttaagacatggataccagacctggtgcggtagctcaagcctgtaatctcagcgctttgggaggccaagacagatggattacctgagctcaggagtttgagaccagtctgggcaacatggtgaaaccccgcctctacaaaaaatagaaaaatcatccaggcacagtggcatgtgcctgtagttccagctgaggccagaaggctgaggcaggagaatcatttgaatctaggaggaggaggttgcagtgagccgaaatcgtgccattgcactccagcctgggtgacagagcaagaccctgtctaaaaaaaggaaagaaaagaaaaaagattgattacatgattaatttgaagttgtttcttggttggctgccagttgtagcaattttatctctacgaaaaaggggggaaaaattagtacctgccagagattaaataagaatgtattgggctcatgatttatttattaggaggtggaatagccaggtagtaaggtgactttggagtcactcctggtttgagccctagctttgtatttaccagctttgtgaccttggacagactaacctctccgagtcctgtccacactgagggacaataatacctaccagaggcacgtgatgaggattcagtgagttaatgcatgtaaagagcttagcacagtgcctgacacacacagtagatctccagtaagtgttagctgttttaaaatgcaagttattcttctgatagaattatcttgcagggagcacaagggcatttgctatgaagaatactcattcctatttagcttaaggtctgtttcttgatgatatgtagtgaaatgataagtatttatgataacagatgaaatagtaaaacaagtataaaattatcagctccaatagcctcattttgcagaggacagtgtgaaagtccataaaggttaactaatttacccaaggttgcacaatgagtttgtgcatgagaactcatgtctcctaattcctgggtcaatatttttccattatattcctttatccaatgtgtatacttcagaagcccaggttatttaatatatatcataaataatatatatatatgaaattaagtttctgttacttaagtacataattgtcatttatatttgctaactctccttggtggttttaaaaacctgtgtcccaaaagcctctgtacagtgtgcattatactattgaaagaaaatttacaattcaatgcagagtctgtactttaaaaagaaacatttctggagctgggtgcagtggcttctacctacctataatcccagctacttggaagactaaggtaggaggattacatgagcccaggagttagtggctgcagtgagctctgattgtgccactgcactccagcctaggcagcagagtgagacaccaacattaaaaaaattaattaattaataaagaatccaggtgaattttgttttaaaaatatgtatgcagaatgatttttacctttgttcttgtctcccctcatcccccatctttttgaatgatagatttgtactttagattgtttgttctttagttgctttttgtctgtagaaagctttggggataaagaccttaaagtattttaaaaattcatgttagaaaagaagattccattgtatctttgtttcacagatcacttaatataacttagccaggtaaattttgcatttcacactgattacttttgtttggccattgtgtttggataagattagcctaagtgccgttttaatgtattaggtctagactagaaacagactttttggattctgtattcttgaatcttccttagtccatgatacccttgctgttggtgttttacttgcttctgttagtagcataaaggaaagtttttatgccatacgtagcagcttggtagcagacaaaatacaaataaccttctaaggaatttgaagaatatcttcacattcttttagagttggatacgccttcagagaaagtaaatggaatgtcttgactgtaaagactcagttaaagtgttttagtctctacagtcagggtgagtgagctgtatagaggaagtcatagtggttgaccaagctgagatacttgcttatacattccaaagtgcccttttctttcagaactcctataatgttgtcattccaagtagaatcttgtgtacctctttcatgaacggatctgaagacggtgattctctaaagcatatcttttcatttttagagttaaaataccaataccacccagaccttagaaagtaaacctattattcattaaagtgaatcagggcttcttggagaagtgactgattctggggctagagtagggaaaaaagggccccttcaatattttggggacatttcagaagatccagaagccagcttggaggggtttccactggccaagtctgggataatttgaatgtcaaaataaataaggacaataaggccaggcacggtggctcaggcctataatcccagcactttgggagaccaaggcaggcagatcacctaaggttgggagtttgagaccagcctgaccaacgtggcacaaccccgtctctactaagaataccaaattagtcaggtgtggaagtgtgcgcctgtaatcccagctacttgggagtcagagtcaggagaatcgcttgaacccggggagtggaggttgcagtgagctgagatcgtgccactccagcctgggcaacaaagtgagactccgtcttaaaaaataaataaaataaaatgaagaaatctataaataaggacaataaatgaagtataactgattgaacaaaaatcataatccgtgtgttaatttagtaaaatagagaaatacggctggcacaggggctcacgcttatgatcccagcactttgggaggccgaggcaggtggatcacctaaggtcgggagttcgagaccagactggccaacatggtgaaaccctgtctctactaaaaatacaaaaattagctgggggtggtggcacgtgcctgcaatcccagctgcttgggaggctgaggcaggagaactgtttgaacctgggaggtggagattgcagtgagccaagatcgtgccattgcactccagcctgggcaacaatgtgaggcccccatctttaaaaaaagaaaaaaaaattaaaaaattagctgggctagtgcctgtagccccaactacttgggaggctgagatgggaggatcatttgtgcctgggaggttgaggctgcaatgtgctgtgatcatgcaaccgtactccagcctgggtgacagagcgagaccctgattaaaaaaaaaaaaaaaaacaccaaaaacacaaggtgacttttaagtttaggagcaagcacttgctgtttgagccctagccaaaattatgaactgtaacgtggatgaggttgttcttttccatatttcctacttcttcacttctttcatcttacacacggaatccctattggctgttcaaacataagtcgcctcctccctgcataccgaacacctgagctgtctctcactttcccctctctaatccaaacttctggcctcttagtagggattgatttttaggaagcttggagaaaaacaaccaagtgttgattttagtaacttgtatgatcataactagctagtagagttaatcctcatttacattttaaaagggttttttttgttttaaagcaaaagtgtgtctttggaaaagtatgtgtgggagggaggcatgttgtaagcaaagcaataaaggaaatgagtaggattttcctgtgttttgactggtgtacagacctccaaagtcagaggagttggtgttcttctgaagagtcttcagtcctctggcttactgaggtagttgtactacctcatagtcagttgttaatagtcaacagctcaggctttggatttaagcgcacagacctgggttcaaattccattctttactatgtaagtgactgcaacattattcaagttacttaacatattcaagcctcagcttcctcatttgtaaatattgtaagtgtacaacctgatagacttgtgaggattatacaaaataacattgtaaaagtacttagtgcataataggcattatctatatgtaagttactaacattattattttgtcagatggagtgttatgtttttgttgggttgagtgttctatcagagtcagataggtcaagttggttgatagcattgttcaagtcttctgtctttactgactttttaaaaatcacctctctgtcaattactaaatgaggaatattgaaatctccaaatactgtgaatttgtttctcctttcagttctgtcagattttgttttatgtgttttgaagcagtgttattagtatatatatatttagggttgctgtgacttctcgaagaatgaacctcttttttatgatgagatgccccttttttgttcttggtaatatggtccatgttcttaagtttacttcgtctaacattggtacaaccacttaagctctttttcattgtttcagagtatgcttttcctttcattagtatttaacatatttgtatttttatatttaaagttaatttcttacagacagcatgaagtggggtcttgtttttttaacctaatctgataatctctgacattttatcagactgtttatagcacgtatatttaatgtgatttttgataagggaaggtttacccctgccatcttgctgtttgtatttatcccaacttgtcttagttccttttctcttcttttcttgccttctttatgaccacatctttatctccactatcagcttgttagctatacctctttgttctgttttgtttttgttactggttgttctggggtttacagaatacatctttaacttacctaccttcaagtagtattatatcactttatagaaaaaagaaaaaaaaattaaaacagtagtgttataccactttacataaaataatcttagacgggaatttttaaatgtaatttattattatttatctatttttattatactttaagttctgggttacatgtgcagaatgcagttttgttacataggtatatacgtgccctggtggtttgctgcacccatcaacccatcacctacgttaggtatttctcctaattaggttatccctccccttgtcccccaccacccaataggccacggtgtgtgatgttcccctccctaaacaggattcttatgtttcttcctcccatcctttgtgctgtggttctacacgttacttggtggtttttctctcatcttgggtagtttcctcatacacatgtgcggtagtcagccacactcaagggaaccctctgcagatacctgcagctttttctatgtagccctctcccctccgtagtgtttgcatgatattttgccatgcaaattctggtcacattggcctccgtgaactccaaatgctatctgctcaattcagcaagtcagctaggctctgtttgagtggcctctccctgtgccaagactttaaaactctcccagcagtgagctgggacactctaggacagactctgtttgtttcccttctttgaggagttaatctgctgtttgtctgtcatccagtgtctgaaaaccttttgttcatatttttgtctgaccttccagttgttaagatagtagagtaaacctgaatgccatcagagtattccatcatgactagaagcagaattattagagaaggattcactttcaaacactaaagaatttttttctaatcataccgatgtcaacacaatctttggttttccattgagataaaaaatattttagaaaagatgttgcattttttgttttaaattagattgtacctgatttatttatgtacttaaaacatagtatatccaaatggttctagcataagaggtatggtcagaagtttcctttctagtttgtctcttgcccatctagttcctaagcaccactgctttgtttctcccactttcagacaacttttgttactagtttcttgtgtatccttttgtgcttttattctgagttataaacacatatattcttatcccactaccccctattttacataaaacatagcacagtgtacataccttactttttttttttttttggaagagacaaggtctcattctttcgcccaggctgtggagtgtagtgggatgatctcgtagctcactgcagcgtcaaactcctgggctcaagcgatcctcctgctttaacccccacaaatagctggcactataggtatgcactaccatgcctggctaatgttcttactttctgtagagagagcagctactcggagacttgagtagctcagtaggagaatcgcttgaacctgggaggtggaggttgcagtgagctgagatcatgccactgcactccagcctgggcgacagagcaagacttcgtctcaaaaaaaaaataaaacatacttttaaaaaaattattttttcgttttggaaatcattgggatatggggaacttaatttccttataaacattagagagcatagttcaaaatcaggaggcttagaatgtggtcaaagaccaagtggtagttcatactttctgaaagcacttactgcctgttacaacatccttatgtctcttgtgtaaatgtcccattttcctttcagtgtgtttatttgaagaggggaaagaattgtctgcccagccggtgggatagtgtagtgcatgtttcccttgtctcttcattgtatgctttgttgtgtttatcatgctattaatactttggatgcgttctttcactttgatcagtatgactcaccaacgaaatggtgggtaaataattgtgagtctccacataaacacattaacctttgcttttttctcaagtaaaatgggatttggaaaggttgtctgacatttataagtcatttaacatgtcagtgcttctattgattgttattctatttgttgactagttttataaactccagcagtctttgagaagcctagtggtgccatttcagtgttcatgattgaatatatagatcaaagtgtgatagattttggcaaagaaaatactaatagaacaacttttatttcagtaggaatatcttttagataatgtagttttgtctactcatacttcctacttgtaaaacagatttagtttactttaaggaaagttgtccaaccattcaaacataaaattatttaaattcaagtttaactttgatgaaacataatttaaataaccttaggtaagatacttaaagtaattccatgcatggatcttttatgtcatgaaacttactatgtttaattttcccagcagaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggtaggttgagaataaccacgtagaaacatagagttttggtttgaggaaaggtcttagagataatatagtgcaaccttgtcattttatgcctgagaaaaatccagaccaagagatgttaaattacttacctaagaaaagcctctgaatcaagctaaaacccaactcttaggctagtacttttccactgcaactcagtggtgtttggatcatctttgtgtggaaattctgacctgaagccacttgaattatgtgctttagtaacaggcctttttgacttgtgaccttgtaaatagtataaactgcgatagtagacctttaactctgtgcaaccattgttaggccagtggcagtaattttaagggttgttgttgttgaattctgttttgttttttgtattttgattttgaattttttcattcagttagagaaaggacagatagaatttagacaatgaaagggactttagcaactatggagtttcagtccctttattttatagatgaggaagttgagagccaaagaggataagtgacttgtccaaggttacacagctagattttgccaatgtcaaccagaacttgtgatttccacacctgtttcttttacccataatttcagtggcaataattaataagactgcctgtaaaggaattcattttgtaaatagggattaattctgttgtaacattctataaccattaaactcagaattagctctgaaagttccttctatgcagtaaggaagtcttagaaagaaaaaggaaattagaaaagcagcagggtgtttaactgtttagctatattctagctggggtcagcaatcactaggctaataagcagtggacttgtgtcaaaataatttttagatattgaattcagtttgtaaaggagaaaagcttgctttctcgcccttcagaaatgtaattagactgtgtaagtaagtagctgtctttctctaggtattttttctctctagagtaaaacatttagagtcaaaacaagtgagctgttattgttttttttttaagttaggaaacatgatagatatccttaatatggaacaattcagagttcatatgacaccatctttcatttttatcagaactaaaaactgaggttttgtatttatttttttcttgagcccacatgaaatgttcacgggatagctatattaagttagtgtatgtatactgtagtacatatagcatgtatgctgtataatatgttttagaaaattgctcaactcagatttggtatttttcttttgctcagaagtgtgatgtgttcttactctgtaataatttagtagacttctaaatgagtatactaaagtaaagaggtaattaactggtacaaatatcacaatgcctatttgtaaggcatcactagtttatatcagagacctgcatatggcctcagattcctcctgttttaagagccactaagccacctattttccatttctacactatgtgtttcatggttaggtggccaagtcctatgcatgtatctcaggtatctttagtgtgaagtctgcacataccatatatgaaagagatgttttttaaactgaatgtccctagagaagcccttttggcctttgtctgcaagttaatgtcctttcaaataaataaataaacactctttacacctgaactaacataactagcttcagatcactaatcatataaatttcttggggcagttcctctgaagttgtgaagaatgtggtagtataaaatagcctttgtggccgggtgcggtggctcacgcctgtaatcccaacattttgggaggccgaggcaggcggatcacaaggtcaggagatagagaccatcctggctatcacggtgaaaccttgtctctactaaaaatacaaaaaattagctgggcgtggtggcaggcgcctgtagtcccagctacttgggaggctgaggcaggagaatggcgtgaacctgggaggcggagcttgcagtgagcggagattgcaccactgcactccagcctggatgacagagcgagactccatctgggggggaaaaaaaaaaagtctttgtactcagttcttcaaaactgcgcaaaacctttaaattaatgttattaccaccaactaaactttctagatggtatcctaagggcctatgcaatatgaaaatccattcttacctgtttaaaaactgcccagtcagccttgccataaatggataattgttcctactgcatcccacagtattattctttctaaaatttctgagatccaggagagtgatctgctcttgcccacatctttcccacatcatttctgttttctccaagccctgtatatgccggtggtgagcagccttttcagcatatgggtcaagtctagaaaattaaatcttttccgaactgcattaaaatttttaagccattttatctttatcaagaaacaccttgtctacactaagatgttttttgtttttagaatttaaatttcagcacctacgtaattttcatacccactgcagtatggcagtataatgctttactatgcaacacacttctctttctttcctttcctttccttttctttctttttttgaagcagtgtgttgctctatctcctggactggagcacaatagcgcagttgctgctcactgcagacttgacctcccagactcaagtgatcctcctgccttagtctcctgagtagctgggactagtggcacacaccaccatgtctggctgagttttttattttttgtagagacagggtttccctatgttgcccaggctggtcttgaattcctgacctcaggtgatcttcccaacttggcctcccaaagagctgggattataggtgtgagccaccgcgcccagtgctattcagcaaatgttgtttgctaatatttttctgaagcttgtttattttgctcttttttctttcttgctagtcttactagccacttaatgttaaaacatgtatactcttacagtacttctatacattctttaaaacaagatatttccattgcaaatgagacgggcagctatgtcattaacacaaaatccttttatgttgaaaatatagttgccatcagctacttttctgttcttacaaatcatcatagcaagaatttaaattgctgagccaaattaataaagcttaatttttaaaacctaatctgtacaacataacttgaattattattatttctttttgagataggagtcttgctctgttggccaggctggagtgcagtggtgtgatctctgctcattgcagcctttaccttccaggttccagtgatcgtcctccctcagcctctcgagtagctgggattacatgcatgtgccaccatgcccagataatttttacttttttttttttttgtagacacaggatttcactatgttggccaagctagtcttgaactcctgacctcaagtggtctgcccgccttggcctcccaaaatcttggggttacagaagtgagccaccatgcctggcctgatttttttttttttttttttttttttaagatagagtcttgctctgttgcccaggctgtagtgcagtggcgtgatttcggctcaccccaacctctgcctcccaggttcaagcaatttttatgccccagcctcccgcatagctgagattacaggtgtgcaccaccatgccgagctaattttttgtatgtttagtagagatggggtgttactctgttagccaggctggtcatgaactcctagcctcacatgatccgcccaccttggcctcccaatgtgccgggattacaggattgagccacaatacctggcctaacttgaatttaagaatctcaccttaaccaagcttcacacaggtctgagagtgattatggattcaggagtatatatagtcacttatgaagaggtatacattctctttgtcatctggacagagcttcatgtggtgagggcaattttaaggcactgtatagacccaatcaagtgttaacctttcccataataactagaaaaccatattacctaactgaatgagatctgtggctttgtaaataacttttttctgtaaattatttatatgaaaacgctcactgtaagacacatgtttagactgcaattaaataaaagtaaataaaacttctggaaaaactcttttgctgctcaaactatttaaatcctgcccttgctaagtgttaataaatccctcagatacattttttccctattctgaaagtgtagcttgtcctgcttttaaagggggcaggctctacttcctcaaagtacctaccctttaatttgttgggtattgcagtagtgctttttaataaacttggggctgggcgaggttgctcacacctgtaatcccagcactttgggaggctgaggtgggtggatcacgaggtcaggatttcgagaccagcctggccaatatggtgaaaccctgtctctactaaaaatacaaaaattagctgggcatggtggcgctcgcctgtagtcccagctactcgggaggctgagggagaagaatcacttgaacccaaaaggtggggttgcagtgagctgagatcatgccactgcactccagcctgggcaacagagcaagactccatctcaaaaaaaaacaaaaaacaaaacaaaacaaaacacccctcattttttgggtttctcaattcagttatttttatttttttaatttgtattagtcccttaatactccattcatggcaatcaattcagtttctaaaagacttcttaatagtcattctgataagctcttctttctaaggaagcagttaagcacaacataacaccttttgcttgtttcattgttatttttctagccagtcctataaaaatctgatactgagctgggcacagtggctcacgcttgtaatcctagcactttgggaagccaatgcgggtggatcacctggccaacatagtgaaatcccgtctctactaaaaatacaaaaaattagctgggcgtggtggcgggtgcctgtaatcccagctactagggaggctgaggcaggagaatcacttgaacctgggaggccaaggttgcagttagccaaggtcgcgccattgtactccagcctgggcaacaagagcaaaaaaactctgtctcaaaaaaaaataataataataatctgatactgattatattatatggacttaaagctttgtacctgaatgaggacaaaaaaatacacagtttaagacatggttatatcttcagtcccatgttctttcccagaacaagtagaaagataagtgtcctcctataccttaaaatgactctattgttgtaaactatatatttaatcaaggagtagtttgccctgccacgtaatttactgtcagaagaacagaagtatgtacccaaaacaaagaacctttaactagcaaataggctttaattattgtgagaacttcagcaggggtagcaacccaggacctaattttaaaactggaagcactgaggatgagaagtgaggcagtggaaatagctctgagctctcagcatctataagtcataaggaaaaaaagtagataaaagatgtatttgaggccgggtgcggtggcttacgcctgtaatcccagcactttgggaggctgagatgggcggatcacaaggtcaggagatcgagaccatcctggctaacacggtgaaaccccgtctctactaaaaaatacaaaaaattagccaggtgtggtggcgagcacctgtagtcccagctgcttgggaggttgaggcaggagaatggcgtgaacccgggaggcggagcttgcagtgagcctagatcacgccactgcactccagcctcagcatcggagcgagactctatctcaaaaaaaaaaaaaaaaaaaaaaaaaagatgtatttgataattatgttgagtgagtaaaaataattaaaaatgtttcatagaagcacatagtgataggcgaggggaaacttaaatcatcatcctggggcagccgtggtggctccatgcgtgaggctggtgccatgcagtctcctggtgttggcattgtctcccagccttctcagttctgcacacagctacaaaacaaaagaacagttgccagcacttggaagaggatgtggatccaaaccaaatggaggacagatactccctctacggacaagatactcatggaagaagtcaagttagaagagcagctgaaggaggctgtagaagaagataagcaagcattggcagatactgaggacttgcagcagatcagccaaaaattggtggaggaggcaaatatgtatagcattcagggcttctgcaaggactcgttagaggttgcagatgttttggagaaggcaacacagtgtgttccagaagaagaaattaaagacaataaccctcacctgaagaacctctgtgaaactctcaacaatgagtggagtccagattcaggaagtgttcagcaagcactgccaagctgaaccctgtcagagccaagttccacccttatgcgcatgaggtctttttttcgtctttcttcacatgcgacaggcaatgtgccagtgttgtaacaaggtttgagggaggcatatctcacacatgaaaacccagcgtgaaaacccagtcatcacacttatgaactacaggaagatctagcatgaggtcttgttccacatgctggtttaggggaaagagctgagcccagtggttctagttacaaaagtgaggttcaagcatgggcagccccttagcgccgcccttgttgatgaggtgaaggaagcttagctgcctcttacaagattttcttttctttaaatcacttgccgtagttcatgaaaagctggttgatgttttttcatctaaatacttttgactttccctaaggctgttggaaagcagaagtaaccagtaggtaaacagaaaagtaagctgatctcacagttgcattaatgaactcctattcaggaatgtgttctctgatttttagtaccgcatgtttaataattccacttacttagtaaaaaaggccaataggacactacaggtcttctagagttcatgaatcacgctgtatctgctcagactctagtgacatcaaagtattttaaatgaacaaaatgtctttgggaattctgctttttggcaatctggacccttctgtctgcactgtgtgtctcttgtgcaacttgtaacatgggagttactggatttcttagcccactacacatttcattcaataaagggaaagcaagggttgaaacatttcttacgctaaaaataatttcatgatgacctttatgaagaacatatgcgttccttagacactgtctagctgctaaaaatgacggatttctggcttttttgtttgtttttggagatgcaaaatgagcatatgtatcttaacggttcccatcacctttattttgccagtaattgaatttgacacagttagttttgccctgttttcttcatctaaatgtggaaatgtttaagtctgtattctactagttactaatgacctcaagatatactccctggtgagatggactttctcagaatatgaggactgcatgcttggcacactttaaatgtgtgtttcatttttaaagaggattaaagccctcatatggttcttttcctttaaaaaattattgaaggcagcacaaattggtaatacaaaaaaatatggacatgaaagctaatacctaaatagattaagcagttaacagcagtacagacaaaacttaatgaacccataaaatagaatgtggcaattcacattgaaatgatggaagttctggatgaaatacacagaaaacataggcaaggaaaatagtcaaaggttttcaaaactggaagtggaaacaaagatctcagccagactgttaagaaagtgtatagagtgcctctcagcataatgttcaaagatagacatccacttgtcaatgtcttaatcacagagtaaaaatttattttagaaaaataaaacgacaactttactcagatgttatagaaaagatgccaggtgcggtggctcacgcctgtaatcccagctctttaggaggccgaggaggatggatcacgaggtcaggaggtcaagaccagcctggccaagatggtgaaaccctgtctctactagaaataaaaaaattagctgggcgtggtggcacatgcctgtagtcccagctactcgggaggctgaggcaggagaattgcttgaacctgggaggcgtaggttgcagtgaactgagatcacgccactgcactgcagcctggcgacagagcgagactccatctcaaaaaaaaaaaaaaaagattatagaaaagatgatcccgtacaatgattagagagtacttgaggtaaaggatttactcactgctctactatctttttttcttggaaaattatgacaaaccttttggagttttgtagagcctaaaagaacttaccaacacaaacctgccctcactttgcccctttggcaaacactgtgaggggcctgagagttaccttatttgcaggctaacaaattaacctgccatggtttcacagatactggccaaagacacgagtctcctgggtcagagacaaaggccagtttcttacagcagtagcagtagccagagcatttgcatttgtgcttatccccgagtatctgttcctataggataatgcagagaagaccagggaaagcctgtgcatgcagtgagttgtattagaggagaggaaccttggatttagggatccttattagacagtaagcagtctacccttttctcttgaaggaggcactatctctgtctcctaaagctgttttctataaagaaatccttgaaaagatgttgcaaaacaaaggcagtcattgcctttgctcacagataggtagaaagagatctatggagaattgtcttcagcatcttataaagggaggaatggtaataaatggccacatttattcattcaacccatactgagcactaaccctgtgcctggccttgttctaggcatgaggatatggtggtgaacagtgcccttgtggagctaacattttagttggggaaatggacaataagcagatctgtaacatagtgttaagtcctacaagaatggaaagcaggatgagagacagtggcaggggtgagttcttttacattatgaaagcaatactgtactggagcataaactgcagtagaaatagaaaaggagttttcggcattgtattgtaaaattacaggggttgtgctgggctgggggaggagaatatgatcccttgacaccagtaagacaggcctctcgggtctctaaaaggagctcagagagtttctagttggaagcgagcactacaggttgagtatcccttatccgagagccttgggaccagaagtgtttcagattttggggttttcccagattttggaatatttacacatatataagataacttgggactgggacccaagtccaaacacagaattcatttgttgaatatatgccttacatacatagcctgaaggtaattttataccacattttaagcagttttgtgcatgtaacagttttggctgctttttgactctagcccatcatcacatgaggccaggtgtggaatttcccacttgtggtgtcatgtcgacactgacaaatttgggatttttgagcatttcagattttttatttttgggttaggaatgctcaaatctgtagtaataatcacaagaatgaatatagtttcttctaagttaagtgctaaaatttggtgcaaatgaaaggtgtaaaaccatgtgtaaactacctaaaaagattgaatggataagcttttgcataaaatacttgaagtagaaggatagatttgagcactgcagtgtgtgcatgtatatgggtaactagttgacagtaacaagggctgcagtcaaggtgatcacaaagtgccatgagtgcttggccatttttactgagggaatgaggtgactgctcctgaccccaagtgtcctgccatccttttagagttaagccagatggtcagactgctgtgggcttccacaggatgtatcggcccttggcgtgtgaggtcagtggcctgtgtagatgaagtctgtgacagcccgtcctgggggtttgttctcggccttattcatgttcttctactgtgacatccttatgagaaccgttgggagaaatttttgattttggtgtcagaatttcacccgaataatttgtttgctttcatcttttgaaccctgaattacataactgttttcatcctagtgatggttgctaaaaaatttagttagagacagatgtatgggctgactcttgactaatttagacatcttccaggaaaacatttctgtcttgtcatctgtggctctgctttaggtctctctccatgtttaatttttttttttttttttttttttttacttattattgttaaaaaaattttttaatttctttctttctctttctttcctttctctcctttctctcccctttctttctttcctcttctcttttcttttctttcttgagatggggtctcactatgttgcccaggctggcctcaaactcctaggctcaatcgatcctctagcctcaacctcccagagcactgggattacagttatttgttattctttttattttctagtctcttgtgctgaactgcatttatcttttaaatagcctttaaatattctttggcagaaagtgagaaacaaatacatatattacacctataaaatcagtaaaaccaaataaaaattatcaagcccaatgttgtaagggccatagggaagtaagtgcatacacgtggttaatgacagtgtgcactgagtttctgaggagtgtggctagcaatagatacttagtgctataacattgtttattcatattaagcggttaatgccacttttggaaatgtatgacagagaaccgaaaagaagatagtccttacaaaattatttatacctacagtgcacaacagtgaaagagggggagcaactcaaatgcacagtggtagaggagagtcgaagaagtcagttaatataatgcagtgttataaagccaccagaaatgattcagtggattagataaatagaaatgtacataaaatatgtaaattatcaaaacatgcattaaatctatttaagaatacgtagatttagcaaaaagaatgagatggtcatggtgagaccgctaggtgggaaggggtccccggaaaaactccagccagcctgcccaccggggtggagttttgggaagtttgcaccatttgtagcagggaggagcctggcccctcttctttctgtgtggagcccaggattctagctgctggcaggaagcactctagcagggactctggccttgtgagtgtctcggattcccccttttcttccttttcacctaataaaaccctgtcttacccaccattcaaaccgcctgcgagcctaaatttttgtggctgtgagacggacaaggatcccgtctttagctgaactaaggaaaagtccggcaacaatggatattggaaataatattaatggataggttttactctcctgcaggattaatataacctgtgagtacttttaggcttactaccagtacaaggaatggcttttggaaagttcttagaatgtagagctgtgcttctgcactttgttcagctacaagcagcctctttgtctctctgtttcaggatctaagcattgaagaacagtcagagtgtgctcaggatttctaccacaatgtggccgaaaggatgcaaactcgtgggaaaggtaacactgttagccattgagagattgcgggtattgcacagggatgactgctcagtctcttagcaatttctttctttctctgatggtctggctggtttgtagacttcatcctgtaacctcatggacattctgggaactggtcttatacttagcagtgcctttgaactgtaccatgcgtatctttccaggagcaattggataatttattgagtaacatttaataactccattggggcagggctggagctgacgaaaacatcttagggcctggctcagtagctcatgcctgtaatcccagcactttgggaggctaaagcaggcggatcacgttaggccaggagttcgagaccagcctggccaacatggtgaaaccccgcctctattaaaaatacaaaaagtagccgggtgttgtggtgcacctcttatcccagctactcgggaggccgaggcacaagaattgcttgaacccggaaggcggaggttgcagtgagctgagactgtgccactgcactccagcctgggcaacagatcgagactctgtcttcaaaaaagagagagagaaagagaaaaacttattggaaggctttgctaaatgaattttccatcttggaatcaccattttggtgagttattgtattaatagtttaaaaaaaaaagagcttcaagtttttagggattctttatggattcaaccttcactgatactagactttaggatatacttagcacatgtgtgtgtcagagaaatctccatttgtatacctcagagagctctacgatgttatggtaaacctcagaaaaatgaaaggataagtttcatcagcattcatcagtcttgggagttgcaaatgcctttgtaatgtaggacagggagtgaccttgctgaagtctccccatttggcagggtgtacactgttaggtcctgtcagacaacttcagttagaactgaggttgctgtggaaggcagcccaacagttggaagaagatttttttgtttgtttgtttgtttgtttttgtcgagacagaatatcactctgtcgtccaagctggagtacagtggtgtgacctcggctcactgcaactctgcctcccaggttcaagtgattctcctgtctcagcccccgagtggctgggattacaggtgcgtgccaccacacccagctaatttttgtatttttattagagaggagatttcaccatgttggccaggctggtcttgaactcctgacctcaggcgatccacctgcctcagcctcccaaagtgctgggaatacaggagtagagccaccgcacccagctggtaagttttttttttaagcgtatttttaaatataacattcttatacttttgttctgagtgtgtttaatttatttctagtaaattagttttttgctgtgtagacagtgctatgaaaatatactcttggccgggcattctggctcacacctataaacctagtactttgggaggctgaggcaggtagattgcttgagcccaggagttcgagaccagcctgggcaacatggtaaaaccccatctccacagaaaaaacctacaaaaattattcaggcatggtggcgtgtgcctgtgatcccagctacttgggaggctgaggtaggagaatggctcgagcccaggaggtggaggtttcagtgagccaaggtcatgctgctgcactccaacctgggcgacagagccagactctttgtttgcaaaaaaaaaaaaaaagagagagaaaaaatatatatatcttgatcttttctctgtctggttatttcagtgcctccagaaagagtcgagaagataatggatcagattgaaaagtacatcatgactcgtctctataaatatgtattctgtccagaaactactgatgatgagaagaaagatcttgccattcaaaagagaatcaggtagttgcttattttgttttgctttgtagttactaccttctaatggaagaacacactggggggaaaataatgcacctgtgtttcaaaccttaagggaaagcaatagctcatgttcctgcttccttagagtggaagcagctctgttgtgtaagaaagacgaggaatgtggtgacctcacctatccatctccctcaaggcagcttttggtaagagttgtgtttggtgtttgagattgttttcaatccctgaaatctccaaggaatagggggactgtgttcttggtccattaccatctcctcaagtgggaagctgtgaatatcggtatcaaggcaggggatgtcggctgggcccggtggctcatacctgtaatcccagcactttgggaggatcacttgaggccaggagttcaagagtagcccaggcaacgtggtaaaaccccgtctctactaaaaatacaaaaattagccaggcatggtggcgcacgcctgtgatcccagctacttgggaggctaaggcacgagaatggcttgaatccaggtggcagaggttgcagtgagctgagatcatgctaccacactccagcctgggcaacagagcaagactccttctcaaaaaaataacaagtcagtagatgtcctctttcctcattcctcccaggggtgtgcatttttcagcattccctagtcacatctttcactggcattggattgatgacatttcccacagcacccagtcttccaggctcactggggtgagccccagcactgtgtactccagttgcggtggacactgaggaagagaccacccaagtgtgggaacagggccaaggctgagctgatgaggtgttttaaggggagaagggactcggagtcccaggttccagacaaggggctggtacttgctagatctgtattggaagtttcatagctgaagtgaggagttgatactgggcaggctgaagatgtggagcccaaggtcaggagccagaagtaactagaggggccctggaccaagatgcagaacagaagcagtaaccaagcaagagggcaggcctgctgcagggtagttggagtgcagttagggtgggaccaggaaacacacagtgattcaggcatggtggtcctgcccgtggcctcctatacaagctccagtgtgcctcagaagttgagggttgaggccaggtgtggtggctcgcacctgtaatcccagcactttgggaggccaaggcaggcagatcacctgaggtcaggagtttgagaccagcctggccagcagggtgaaaccctgtctcgtaaaagtacagaaattagctgggcatggaggtgggcgcctgtagtcccggctgcttgggagcctgaggcaggagaattgcttgaacccaggatgcagaggctgcagtgagccaagattggcactccagcctgggcaagagtgagactccatctcaaaaaagaaagaagttgaggactgagtgtaaaaggacattaacgcagtaggcagcgaggacaggcagcagccaattctcaaatggtcactttcagatactgagtgcatttcagtcttggtagcactgcgtaatgtcatttcagtcagcaagatggccttccattcttgtgataaatgcagaagtctcattttaggatcctagctgcttcatcacgtcattagagctcgtagtacttgcaggggtgatgtgtgtgggcctgggattgagtggtcagtgatgcctcaggctttccctaaactgaaggaggtgacaagacaaatggccacagtttatccttggagctcttgtttactgtctctctctctttagagccctgcgctgggttacgcctcagatgctgtgtgtccctgttaatgaagacatcccagaagtgtctgatatggtggtgaaggcgatcacaggtcagtgaaaccaagagcctttttattgggatgttttccccttaaagttaacattttactgtaatattcatctatacatttgtaaaatgcagattgtcgaaggtacattggaatgtagtaaaagtgatttgtaagattgttttatgaatttgatggcattcagaagagcaggttctcttttacccctttattttcagggattatggtctcgtttcttgggcattaaactaaactaaggtcaaatgcagatagaataaattttttttcttttttttgtacttctttttttatttagtttttattcagctgactgttccatgatagaataaatttcttaggattcagttgcatttatatattcaaaataattttggatagaggaagggaactggtaaggcaaggtaatccccacgctggagtaacgtagtaaaatgatgcctctgactggttgttagagaagcgctatgagttatttttctggtttgatcaggaaataaatgaagttccccaaattgatgtgacactgccgttctagacaggtccagcctcctaataaggtttgtttctcattcatgggaatgaaccagcaagagtgcaacacaaacgtttaaattacaaaaaaaaatcttaatggagagatggtcatctttggccagtgtctcctttattagaaagaggccttggaaaggcttgttcatgtagacattgttaatgaaattctattggaaaggaagtgggttaactgatattagtagtgttggaggctggccatcgagtaggctccttttgttacaggaaccagagactcacccaagctacagaagaaatggaggtttgcttaaggtattatcagggttataaaggaggtggagtctttcaggaccctagccccaagggtcatccagggagtgggctatcttactgcctctacaacggcaagagggtctgctccaggcattctctgctgatgtgattcttccactttctcgggttctgcttctctttatcttcccgtgtcaactcctgttgttaagtaaattactagtttctgtaatttcttgtgcaagttctgaaggtagaatccaagtggcccagatcaatactattgtttttttttcttgcaagcttttctgctaggctatggcgtaggtcatgactactctgccccccgcaccttttgctcggggaaccccataagaggttgaaggtggaggccttctaaaagcctgaatatggacctgggacttgtgtttttcctgactcttactagaaagttcaagatcagctggtttacatttagagtgttctatgagagttttgtccaagccaccgtagcctttacggcctgttgctaatagggaagtccccagccttcctggcctctttcacccaagtagggcatggttcactgggcgacagctggtagcgagtgtttgtgtgacccatcagtggtgaaagtagaggtgggtggcccaagggatcaggaaagcatagctgtgttccatgaatagtgggactcgataggagaggctgcccgttaagttacacagtgtgggtcacgttcttctagggcaggaggctcatgttctgggctgacaagtaacaaatacgaggtctgttgaagagaactgcataaaattttgaaagtcatcaagtcctctgccctgaggtcgaacactctttaggacttctgaaaggaagagtgtgccaccccaggaaggggatcagagagtccatcatcagctcctcttagctccaagagtttaggacaaggagagtgtcagggcctgtggctgatggtggaagtttccctttctttctgttttgtttaatttttaatttttatgtgtacataataggtgtatttatttatgagttccgtgagctattttgatccaggcggataatgagtggtaattaccttaggggaaatggggtccatcctctgaagcatttagcttttgtattacagagaatcctgttatattctcttaattactttttaatgtacaattaaattacttttgactatagttcccctgtcgtgctagcaaatactaggtcttattcattctttctaacttttctggtaccccttggccatccccactatcccccatgccctgcattacccttcccagcctctggtaaccatccttctggtaaaacatccttcagttttaagtgtttagctcccaccaatgagtgagaacatgtgatggttatctttctgtgcctggcttatttcacttaacataatatcctcctgtttcatccatgttgttgcaaatgactggatcccattctgaatagtactccactgtgtatgtgtgccatgttttctttatccattcatctgttgacagacaccctttcccatttggctccacctgcatgacttctgtgtggctatgggggcagtggttcttagccaggcaccagtggtcccccggagacattggacaacatctggagacttatttatttagttagttagttagttagttatttttgagacaggatctctctgtcacccaggctggagtgcaagtggcaacgatcatggctcactgcagccttgacctcacaggctcaagcgatccgtccgcctcagcctcctgagtagctgagaccacaggcacgtgccaccacacccagctaatttttgtttacattctgtagagacagagtttcatcatgttgccttggctgctcttgaactcctagactcacctccctaagttactaggattacaggtgtgagccactgagccaggcctggagacatttttaaatgtcacagctgtgggagtactactaacacctagtgggtagaggccaaggattctactaaacattctgtgatgaacaggatggttccctacaacaaagaattattcaaccccaaatgtcaggagtgtccatgttgagaagccatgacctggaggtacagcctttgttttcacaactccattaaagataagcctggacacctggatccagcagagatggagcgtatacttagctctgtgtttcctattcatgtgaaggcagagccctgggagaagacatagagcaattatgcagggctctgaagagtaaatcatagcaggcaggctggggagggaaattattagacagcagtgagtttcctgtgtgttgctttctcctcacatgtctcctagttgagactttgaagcagtgcaaatcatggaattgcacacatgggaaaatccaaagagttccacgaagaattccttcaggccagaggatgctaggaacgggtctctgcaggatgaagcatgtggaagagatccctgggggtgtttgtctttctttattctccttttccttcccttctctccctttttccaccccagccctgccttatggcaatagcagccacacatccagataaaacataattcactttttactcgctttcaaaatgtcaacagtaaagatgaacaggatgcaagatgaaagaacattgaaaaataaagattaacaagaaagtagtttaaataaaagagagaaaaaaaaatcaccaataaaaggtagaaggctaaagataaatgaaggtagtaaaaatggctttaaaaaatcttacccaatcttacccaattcttatttagaataagttccatataagtagaaaaagaaaaataaatagatcaatgtaacaataattataacccaggattaaaggattaaaggaagcaaacaataaaacagcaaaaattatgtaattcacacagtagcctcataagtaagggaataaaagcactcaaaagttaaaataatgcctgtgcactgcctagcacatctgtcccccacacgttgtctttcatggcagatgggcctaggagggttccccaggaagctgacctcagggatgatctaaaagctgaaagaaccctttggtataccccaccgcctggccagagtctgaaacgtttattcctgctagtggcaagaatttggtgtaaaattaagctgccttggctcttttcttttgtgatgtcccaagttgctggccgatgtgcaaccccagaggtacgctgcctctccagcggtgctgtcaccacgtgcttcagcacccttcgctgtcccccaggcttgttggaaaagggtgggcattcatgagagcccactgcttggacttagtgatagttgtgggtagtgaaatttttctgccgggagcagtgagtcacacctgtaatcccagcattttgggaggctgaggtgggcggatcacgaggtcaggagttcgagaccagcctggccaatatggtgaaaccccatctctactataaatacaaaaattagccgggcgtggtggtgcgtgcctgtagtcccagctactcaggaggctgaagcaggagaatcgcttgaacccgggaggcggaggttgcagtgagccgagatcgtgccactgtactctagccggggcaacagagtgagatgctgtctcaaaaaaaaaaaaaaagaaagaaagaaatttttccctgggagaagtaaaatgttattttgagattaagtttattcccttgcttgatcccctctgccaatcagcaggtgtgaatgttgtgatttctgtagctagtggagatccacatgctggagagtttggccactgttgaactaagtgtgtcggattccagtagctggatttttttttttttttttaacaagattttgctctgttgcccaggctggagtgctgtggtatgatcgtagctcactgcagcctcaacctcttgggctcaagccatccttctgcctcagcctttccagtagttggggctataggcacacattaccacactcggctaatttttgtattctcacattcaatacaaagatgctttgtgtagtagccacatttctaaaaagcagtatgcaaattgggactgtcgaaaaacattctaaaatgtaacagaggcacagaagcagtaaaaagactcttcatcagacaacttcttccttctccatggagctcagaggcagcttacattgtgattagaagtgtgggcttggccaggcacggtggctcacgcctgtaatcccagcattttgggaggccaaggtgggcggatcacctgaggtcaagagttcgagaccagcctggccaacatggtgaaaccccgtttctactaaaaatacaaaaagtagctgggtgtggtggcgggcatctgtaatctcagctactttaaaggctgaggcaagagaatcgcttgaacccaggaggcggaggttgcagtgagcagagatcacaccactgcactctccagcctgggcaacaaagagtgaaactcagtctgaaaaaaaaaaaaaaaaaagtgtgggctttacagtcaggtagacatggtttcaaattcccaccctgctacatactgtctgtatgatcttgggcaaatcatttaacctctctgaacttcagccccctcatccctaaaatggataatattaataagagtatccattgcataatatgaggattagagaaatgtgcttgtagggtacactgtgtattacctggctcttggttctgttttccatgagtatgagatcatatttactaagttattatatactaagttaactgctggaaaaggggttaataaggattccttcataactttagagataaaacatgattttcctattgcttcttttttgtgattcttttctcctgggaaatattgtcttttctgctttgtagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctggtgagtaagtgagttcttggtgttgtggagaaggactaggaaggtggtggttttggggatgtgacaggtcacttaggcccgtgacaggtgaatgcttctgtgtgagaaggcagcatggctgaggaagctcactttgcatcagggagcacaaggaccaggccatacagacactccgcctcccagcacttgatcagagattgtgtttatcctacggaaacagatgacatgtgttgggcatcactccccacggtcctgggtagaagagtccttcacttggcagggctttttcaaccatgaataaggcaaattatgtataagttaataaggctgaatatttgccccctcattcattcactcattcattctactacagggtctcactctatcacccaggctggagtgcagtggtacaatcatagctcactgcagccttgacctcctgggctcaagcaatcctctcacctcagcctgctgtgaagctggtaccacaggcatgcaccatcacaccgggccaatttttttttttttttgagagatggggtctcgctgtgttgcccaggctggtctcatactcctggactcaagcagtcctcccaccttgacctccctaagagttggaactgcaggcatgagccaccactcctgacctgaattcttcctttttcttcctactaaactctgcttatttgctttagagggaatgtactgtaaagctaatgaatttggagacttggggcagcgtatggacttggttttctgtgttgagagcctgggaactaagaggtggggaggggaagccaggatgcattgcgagtatttctgataaattgccaaaaaagtctcacaggtacgtgaatctctcagtctctaaaaatatgtcatgatttatttctaggttctaagtatgtattcacatttatacctacttttgtatttgtcactcttcttccttttcctgtaagtaggttcccaaaattgtataagcttcaggttcctccaaacttggacctgcccccatcactcatcaccctccagcattgtgttcagctacatgttactgtagtcaccagcatcttgggagtgtgatttataggtggagggacttggtgctcttgatcagaatgatgcttttacctttattcacactgttttccatcctcccaggcacatggtggtttaatctgtagtactgaaaaaagtttaagtggcccatatagaatgagattagaagtactcatatatcctttttttttttttttttttttgagatggagtctccctctgtcatccaggctggaatgcagtggtgtgatctcagctcactgcaacctccgtctcctgggttcaagtgattctcatgccttagcctcccaagtagctgggattacagatgtgtgtcaccatgcccggctaatgtttgtatttttagtaaagacggggtttcaccttgttggccaggctggtctcgaactcctgacctcaagcaatccacccacctcagtttcccacagtgttgggattacaggcatgagccaccgcacctggcctcatatttcttaatataaatgaaacatacacttgcctacgagggaagagcgttttggattcagttctttatccaaagcgagtcagacaacctggaagtccctgagaagtgtgaaggtggagacatggcaggtattgagagaagtggaggaggaccaggacgtgtttgagcgtagccacggtcactgacagtagaggtggctggcttgcacacacttagcagcttctagtgcccttggcctgcagccttaagtacatttgtgccttctctctttgtcctcttcttgcctgactcagagtctgtctcctacacccattgctccaatgaaactgctctggcaaaagtaaaaagtttccagctgacgaaccccacgggcactcacagtcttcatcttccttcgcttctcatagcactctccaagagtcctttgttctgcaacttctgttgttccttggcttccacaattccactacttccttgtctctttgtaaagtctgtgtcttctacttccaccttgaattgtgtcattccatgggactccattgtctctgcatctctcttcctgcaccatcttctctgtcacagagctgtcactcactgtgcagtgatggcctgcagctctgggtcacctgtcttgaccttacacttgtattgcacctcaaatataatttgttcagagctacttccccttcagatgtttgtttcttttccagtattctctattccttttagtggcaatgccatgtctccattcacctaagtgaggagttagaatcacctcctctttccaggtcacagaggggccacagcaactccacacacaccatgagccagatggtgttccgttctactcagatgaatcagatttttctttttctttattccttttttctagagatggtttctaccccgactgtttcccaggctggtctgaactcctggtctcaagcaatcctcccacctcggcctcccaaagtgctaggattacaagcacgagccaacacgcctggctcagatgtctgttgaattgggcatttgcagtgccatgtctgtactaataattgctaccgtgtattcattgctcgctgcaggcctctcggaagcacgtgacatgttatgttgtttaattctcacaataaatctaggtggtatttccccccatttacaggtacagaaacctcagagagcttaagtaactttcccacggtcactcactgttgttgttaagtgaaagaggtgacagtgaactcaggttcagtcacttcagagttgttccttttttttttttttcctgagacagtcttgctctgtcacccaggctggagtgcagtggcgtgatcttggctcactgcaacctccgcctcccaggttcaagcaattctcctgcctcagtctcccaggtagcggggattacaggcgcccacaactgcgcccagctaatttttgtatttttagtagagatggggtttcaccatgttggccaggctggtctcaaactcctgacctcatgatccacacgtcccagcctcccaaagtgctgggattacaggcttgaggcaccgggcccggtctggagctgttcttttaaccacttgatgttaaaatattcatttgaggatcagaggtctgtgtgccacacctacttggggactatatcctgggtggggatagcaggtctgggaagactcagacagaatggcttcatggtgcacctggggaggctgcacccagacatcggccctggagctcctgggagtgtataggaagcacgaccggggataggagtaggtaatttttgaggctgaaatacacagaagttcatgagtttgttttgtttactttagcttctgttttaaatggtctgtgatcaaaagatttttacaaatcgactcgagtatgcatagctttcctaatatgactgtattaacgtcctcttcttgtagtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttccaa

SEQ ID NO: 1936 - DNA, 18996 bp, Homo sapiens
ttgaatcaataaatttattttctgcttaagcaggttgagttgggttttctatttgcaatagcaaaagtcctgactggcaaggtttaaaagtttgaagactctcacaggtaagtgcagctcaggatcctgtgagtgcagcagaaagtcttaagaaatggcaggggctggttgaacccagattttccattggctgagcagatatccccagaggcgtagaaaattaaatttgttttatgttgttccaaaagaggagaactgaggccagaggagcacacttctgagacactcatttttgctgggtagaggaactctctggcaagcaggaccatcgatattagagcagctggcctcaggagggagtaagagccccatccctgaaggtacacaagttgtggcagcaaccatctggcctgcagtttccagaggggagtcaggcgtggggtgggactggagtgaacgggtagatgcttccacatgcggcagttggcactgacggcaggaacacgggggtggcttaatgggtcctggggctcccctctggccctcaggaaggcaggagcatgaggggcttgggatgcagcacctgcaaatttgcacgttcctggcctcaggaggcctccagtacagaaaagaccatcaacgaagctctgcagccatctgctaagaaacgccacagggaggggacagcatggccagccggggtgccatcaggctttgggtggggatcctggaggatcagacccatctaggtgggagcgctggggtgcaacctggaaggaagataagcagggaaagagaatttggggacatgcagaatccacagctctcgccttcctggctcacagctcattcccacctccaggtctttgctcaaggtttgactcccaccaggactgccaatgctgctctccccacctcaccagtcctctctgtccttctggtcccacacctccaggaggccttgtgggctgcctccaactcactgaccccaccatctgccccctggggatcatagctcaggctctcccacctccacccacatatgtgggtgcaggatctccctggctcgactgggctctcctagggccagggaccaaggcatcttttccatcacctcctgcaggaatgggcagagtggggctccgtgacacccactccctggcccgggggtggggggttaccaggcattcattcataccttgggccttgcctctggaagatgagctccagagagtgagactggcccaggcagatgacaagtaggctgcggaaactgaggcaacctccatacccaccttctttctgtcctggcctaaatgccactcacagtgaaccaaaggccactgctcagccagggcctgctgtgtatgggagttgggcactagagtgggggactcttacccctagaggaggctgcaggcgcgcttctgctgccgcgtgggctgagggcacagcacggcccggatggcctcgtcgaacacggttttcaggcctctctgggtgagagctgagcactccaggtatttcaccgagtctggttggggagatggacaggagagccaaggcctaagtggcggggggggttctgggccaacatgtctcctatgccatacaaccccttccacgccatacacccctcccacgccatacacccctcccacgccatacaccctcccgtgccatacacccctcccacgccatacacccctcccacgccatacaccctccctcccacgccatacacccctcccacgccatacactcctcccacgccatacacccctcccacgccatacaccctcccatgccatacacccctcccacgcctcccacgccatacacccctcccacgccatacacccctcccacgccatatacccctcccacgccatacaccctcccacgccatacacccctcccacgccatacaccctccctcccacgccatacacccctcccacgccatacactcctcccacgccatacacccctcccacgccatacaccctcccatgccatacacccctcccacgcctcccacgccatacacccctcccacgccatacacccctcccacgccatatacccctcccacgccatacaccctcccacgccatacacccctcccacgccatacacccctcccacaccatacactcctcccatgcctcccatgccatacaagccctcccacgccatacaccccctcccacgccatacatccctcccacgcctcccatgccatacacccctcccacgccatacaccccctcccacgccatacaccccttcccatgcctcccacgccatatacccctcccacgcctcccacaccatacacccctcccacgccatacacccctcctatgccatacaacccctcccaccccatacaccccctcccacgccatacacccctccatgccgtacaccccctcccaagccatacaactgaacaccaggctctgggggccgccatccagtcccagtggggtcacctggaggctgtgtcaccaggagcaaggagtttaacgtcaccgtgcctcagtttcctcatgtctgtaatagcgagcgtgaactcagtgagagactaaggcctccagggcaggtctgtgtctttcttggacacatagcccttagtccgtggaaggagggcgggaattttgatgcttttctgtgaaggaaagggctcaagcatcagtgaccaaatctctgggagcctcaccttctagaaaattgtcttgcccatccctccaggattctcccagggttgcaaataatccccaggaggcctgaagccctcagggccccctccccaggaacttcccaacatcatcagccccttccttagcaccgtccctgtcttacagacaaggaaactgaggctcctggagagtatgcgactcatccaaactcacacgctggatgtattccctcaacctgggcccagctgggggccttctgggaggagtggcattggagagctcctctgtcctgccatgggaggcccagccttctcccacatgaagacccctcagggctagagcccggggcacagatgaggagaaaggcaggcctagttcccacccccagggacggcgttccatgacattctgcaaagagtccgtgtgacttcccatgtccatttcaagctgcacagtttccctgaagtgaaaaaccacaaaaccccttctgccgagatgctatgcaggcctgggggccgatgtcagaaccaagaggaaggagaagggaggggaggggaactctgggccctccgccaaagcccgcttgcttctctgtggcaggatggaaggggatggacgctggtcaccacctaccctgtgccaggcactgagctgggtgcttccaacaacaccggggtgagttcccatttcacagaccaggaaacaggcccagagtggggaagccaaggcccgaaggcacagagctggggggagaagtcgggatggcaggaggggcagcccctggaacaggggagcccactgaggccaggtgctggggagaaaggaagggtggggcagggacgaggagcctgaggctcagagaggatgtcactcgctctgagtcacatgctgggcgtctcccctctacctggaggcatatacgcccaccagggatcatgggcagtggttgtcatggggcttggctggcaagagcagggtgccctgagctcagcccggagtctggtcaccacagccccctgtgttgaggaggtgtcactgggcacttggccactgtctccttataagggaccacatctgcgtccacttcccccacatccaccaactgccttttccctggcacccagccacccactcacccaggacaagggtcctgagctggggggccagggctcactttggctcggcctctcactgctctaggactttagtcagttccccctctccgggcctcagtctcccatctgtctaggactcattgccatgcgatggctcatcaagctgaggcagggggcaggggagctacagagagggcaaggagggtgagggggcggtgggggcagtggaggtgcagggaggacagatggccctcagctttgtggcttagggagccagtccacccctgtcagaatcctggctgggtggccttaagccagcaacatgtccccccgagcctgtttcctctctgtaaagtgaaggtgacaagagctcttcgtcatagctgctgtgagaatgaagtggctcccaggaagtgctcagtccacatcagctgtgattatcagctgggctcagggctgcccccaaaacttgtcatcccagggctggggagtccaggtgggcagaggcagttgctgcttccctcactatccctgccagtccccccaggactccccctaggcctaagctggtctgaggcacagttaaaatcactgcccctgccccagctccatgcagggtcagccaggaaagactggctagaggccaaggcaagaactctgagtcaccaccttatggaggagagagggcctttggggattgtccaggtcagcttatgtggagagggagactgaggcccagagaggggcagccactaacccaaggtcacacagccaatcagtatcagagccaggaccagaatccaggcctccagcaccctccacatgatcccaaagcatgtgctttacaagggagaggtcagtgacagccaggccacaggctggagagctgcaccctgaatagaaggagtccaggggcaggggttggaggggtgctggttggtcagaaagagaaggcagggatgaatccttgatatttaaaaggaaagacttgcaggctggggagctgtggccctaggacaggggaagggagccagggtgtgagccatagtctgaggcccccggggaagatggctgtgtcaccacgctagtcacagaaggagggaggtggtggctgcggtttctcttcctgtgaagagatgtgagtccccagggccctcccagttccggcagggggaggtggggcggggctggggcggtggggcgggaggaggtctagtggattcaatttgggggccaaaccctgggcctgcagagtcctgtggtgaggcagagggcacagctcatatgaccaaacccagctggtggttttgggcttttgggcaaggatccctgagctacagacacattgggacctaccagggacagggacaggaacagccagcaggcctgggtaccatgcatgaagccagacccatggtcatcgcctccctgatgcaggcagccctgagccactacaaagaagcaccccccagcagtgagccaataatttgctgtccttccttcaaatctggctgggccacctactagctgggtgaccttgagaagttactatatttctccagcccagtgatttggaggcaaagaggggtcgagctgagaaaccaaagggagtggggaaagggaggagagaaggtggtggaaggaaatgtgtcaccctttagatctaatgcagcgccacctcctccaggaagccttcccagaacacccaagtttgacttgccacttgtcctccaagcaaccacagcacccccactcaatctctgcttctgtctgctcaaagcacacctccttattttcagtatctattaatagatactactcatactactaggacgactactactaacacagagtgcttctcacacacaggtgctgccctggcagctccacctggaataagttactgaattcccccaaccaccccaggaggcaggagctatcactatcccatgcttttctgataaggaaacacaggcagagagaggctacgtgactcgcccaaggtcacacagcaagtgcacagcacagctgagttcaaactgcacagcctggccctgcagcccgtgtttacaatcacaccacgaggccaagtcagggcctcccctgcagccagatcgcccctctgagcccgaggcccataccaatctccttggccagtgccaggccctgcgggtaggtgatgggagccagcttcttctccttcagtttctcgatggtgtccttgtcgtcccgcaggtccagcttggtgcccaccaggatgatgggtgtgctggggcagtggtgccgcacttctgggaaccactgggcaggtgggtggggggacacaaggttgtatgggtcaagagggggcgcgaggctgtgcggggatcagagggagtgtgagggtgtagggagaggagaggcagcaagttgccagaagatcagaggtgggcacgacggtgaggagagagagacgtgaggtggcacagggaggggaggccacgacgttgtgcaggaaggagggggcgcatgattgtaggaaaggaggaggcgaggttttgtgcagacataagaagcaaacatgaggttatgtgacaatcggaggcggacatgaggttgtgtggggaggaggagaatgcagccatggaaagtgggggtatagctaactatcgcagcaccccccaccccaggtcctctgaatcttaccccctcaagtccctctgccagccctggttggcactggggaccctctctgtatgcgacctctgctgccccagggaccagcctagagtcaccagttcctccctctgtccctcagggttacctgccccagagcccccaaggcccaccctgtccagctcaccttggcgcggacgttctcataagaggctgggctgacgagggagaagcagatgaggaagacgtcctggggacagagcaagcgaggttgctagtgaggagggcccagaggtgtcccaccatggcagccaccgagaggtggagcttggggctccctgagggtggaacaccccagggaatgctggggacttaggatctgggcagagcagagatacccttctcgcctctaccacgaggctgctgtttgttaggacgctcactaaaggccagggcctctgcgaagtggttatcctcacatgtcactctgcagcaagcactgctggtagccccattcctcagacagggaaagtgaggcttccagaggttaaagagtttgccaacgtgcactctggtgaggggaggatctgggattctagagtccatactccaatccatatactatccaccatctgattaccggccttagccgcctccctgcataccctggaggaagggcgaggacccagcagccacctgcaggcatcctccacctctcccctcccccagcactcccagggctcaccatgctgggctgcctcctggggccctgtgcagaatccacctgccccaccactggaaacagggggtgccagagcccaggaggcaatggggtgggaagatgggcacattgaggaccgggaaccaatgcagggctgagggagtgcaagaggaagcccttctctgcctgggacatgcaaggcaggcagactccctgagctgggccttaaggggagaggtagggtttcccaggctgagctggctggaagggcatcccaagcagagggaacagagacagcaaaggtcaggactgcaaggcaggtgggagcagcacaccgtctgtggataggagagcggccggagacggtcgtagtcctcctgcccagcagtgtcccacagccccaggttcactggcttgctgtccaccatcacattggctgaatagttgtcaaacctgtggggagcaggcaaggcggaggtaaggtcaatctcaaaccccagaacctgggaattgtggtccagctccatgtcattcctcggaggctgagacctagagacagtctgcgactggcccaaagtcacacagcatttgcaattgggtttctttatttgtttcattactgattcattatattttttaaaaatgtaatacaagttaacaagaagaaaaaaagattgtctcttaatccttttcctacccgtacctgtcctttggaaaggtaattgaggctgtgtaacttttcctcccagtcttgatgagaataaacttacctctctccctatgctgccactcaatgtttgctttttgttgttttttgtttgtttgtttgttttttgaaatggaatcacgctctgtcgcccaggctggagtgcagtggcaccatctcggcccactgcaaactctgccccctgggttcaagtgattctcctgcctcggcctcccaagtagctgggattacaggcatgcaccaccacgcccagctaatttttgtatttttagtagaaacagggtttcaccatgttgaccaggctggtctcgaacccctgaacttaagtgatccgcccgcctcggcctctcaaagtgctaggattacaggcgtgagccactgcgcccagccgcaatattttgtcgaatgaatgttcatcccgtctcaggctgggtccccccagaagcaaaccctgagacaaggaggtgatgtgaggggtttattcgggaagtgactccaggatgctgcagaaggggagtggggaggaataaaggaggggacagcagctgacacagggcaggtggttgagttgtcatggctgtggactgctgctgctctcagtcctgctggggccacctgggagacagaacggaccgtgctcagggcgtccccagagaaggcaggaagctagggtgctgtcattcatctcccatcttccagggaaagagggctgcttccggggcctttcagcccaccccagagtgtgcgtgaaagctgttagtcactggccatgggaagggccacggcaaacggtagaaagacacatgctgccgaggagatggtgtgaggcactgaccttgactcccaatgtctcccgccagacccagagagccctgcagggccatcgaacgagcctccagatgcacttgctaggcacctactatgcatcgggtgcagagccagcgctggggccaccaaggagtacatgcctgatcctgcccccacagctggcggaaggccagacacggggtgaggggcctgacaaatatcagagacggggaagcccaacgaatgctgggagggccatcccagggctccaagctcggaataggggaggttttgcaagccagttcttgctacacacatccccgcgaggaaggtgctggctacccacgctgtggaagggaaaacttggctcagagagatgcagtgacttgcccaaggccacacagccagtgagtgacccaactaggtaagaaaccagaaaccagtgaccacgaccagtgctcactgccccaggccacagctgtgcctccgggaatgccctcaccgcctgcccctgagggttagggaatcactgtcacttttcccgctgtggtcccccacacaggccctgacctggtccactgagacctccggctcctctgacttctcctcctactcctcccctcgcacaccagccaagccgtttcccgggaaaggctcacactgcccacctccctgtgctggtccacacaaagcccctgcccagaatgtccttcccaccttagctgtccatatgttctcaccaacctggtctctggcccccacaccctccaggctgcccagccctccaagcctttgatcctgtctgtatctccctctggaatacgcttccagccccatttcactcccaacttctattcatgcttcaaaaccctgcccagacaagtcctcctctctggcggagcttcgtcgtcctctacctgtaaagagcccatggttccctctctcaggtgactactttgcctggaccacgagcaggcacttggtgagtctccaccccttcaagggctgtgggttctgtgtgggccaggccgatgcctgcttattctccacagtctcaggcctgtcacccagtgaatgcaggtggaagggaattaaaccacctcctccaggaagtcctcagagaacgctactcaatgttaggctgcagaagcgctaacacttcagagtaacacaaaagacacctctcctgagaggagtcccccacacccccaaaaagtgggcagcccagcctttttaatacactttgcctgtccagccctggacagaattcctggttacctctcagttcctcaaacggccctgttcccgcctgtctggaaagtgcctgcaaacagtggcccctgacttcccactctccttcctctctcccttctcttcctccccactgccaggctggctgacttttactcatccctccagcccctgctcaatgtcacctcctccaagaagcctttcctgacttccagccatgtcggggctaccaccccacctaaaccagcactccttggggaactcagcatcccaggtggcaggcactaagcctcatttgtttgccgctgcaccctggggccagcccgcggtctggtgcacagcaggtgctggcgtgcacctactctgggtaccacctacactgctgtgggatttcaggaagaaggcgctgtccagggagacacagtgaggcatgatgggaaaagccacacctgtgttgtttttccagttttgaccagaaacacacttttgggaaatgcttggacactctctcctctaatgtccagccacagtgctagtgccaagaagccccacaagattcacctgtctcctctgggtcatccctggaatctcagggccacggtgatggggaaagagctgggaccttgagaagcaacagccaccttctctgaggccaggcagggggctgagggtctttgtatgttaggtcttgaagtctcatgtgatccaagacaaaaggatcttaagttacccccattagacagatgaggaaactgaggcctgaagaggtcaaggacctttcttgttgggcgggaacacagagttccttgggaagccaggacatcctggctgtgtgaccctgggtgagtgacctaacttctctgagcctcaatctctttaatgtggaggggaaaatacctatttcttggagccattaggagaatccaaaaaaacagaggatgttcaagccaccccactgggagatgctgagaagctaagcagtctcattttccatgtccccaaatgcccctgccacagggcccctccccagaggaccagagggacaggtgcaggaatgtgtcaatggtgtgacacccctgagggtcccccttacttaagagacccacaggcagccaggaccagagaggaaccttatgcacagaccaccatgggcaaccctcaccccattttccggatgaagaaattgaggcttacagagaggaagggacttgcccaagatctcccagccagtgggtggcagagcaaggctagatcctgttacccaattcagaaaggcccacatggtaagcatcgctgctatttcatggctggaaatggagttggagagagcagagaccatgttttcatctagtgcctgtagaactctgaggcctggccctagaatggagtggaggaggggaatggggcaggtggaaggggccccagcacccaggtatcacctgaccaccaccgaagcccacccccacggaggaaggatggtgcattcaaggaacccagagaccacagggcacgcatggctagtgacttgggggtgagaaaggattgatgtcataggggcacggaccagtcaggtcttggttctcagggcaatggggaaccagcaaggggccaagccaggcagaggtgatgagatcagatttgcatttataaaaggtcccagctgggcacggtggctcacgcctgtaatcccagcactttgggaggctgaggcaggtggatcaccaggtcaagagatcgagaccatcctggccaacatggtgaaaccctgtctctaccaaaaatacaaaacttagctgggtgtggtggtgcatgcctgtagtcccagctacttgggaggctgaggcagcagaatcgcttgaacccgggaggcagaggttgcagtgagccgagatcgcaccactgcactccagcctggtgacacagcgagactccgtcaggaaggaaggaaggaagggaggaagggagggaggaagggagggagggaaggagggagggagggagggaccctcttggagaagtcttagggaggggccagaggggaacagagggggaaactggcacatcagccaggaggggaggcccttaccgtgctattggttgaaagatgaaggcagctggaggtgtcacggggcagggagaggtggagcaggagggaacagaatacccaacagaaggggtgcctgagctaaggcagaggcttgagccactggacatcatgaggcacccacacacacagcggcaggagcagggatggggctgccgagaggccaggcagaacctggtggggcctggcgcacacagctagggaggctgatgtcatcctgtccactggaatcccaggctggattcgccagtttaccgaagagaggatttcaaatgaaagtgaaaattaagtgccaaatgattcaacctcaattagcagcacacattcttccatgcagagctgagccctgccttcctccccggggtcggggaggcagtcatgacggagcaacaggaatgggctcagctctgttctagaaactggcgcgatggcagggagtgaggcagataagggccccgtcctcagggagcttccatccaagaggaggagtggcagcaaaggagcagcaagatgaagtcgggctgtcggggggcctatgaagacagccaagcagggtggtgggatggagagggcaggttggagacggggggctgctgtagacagggggtcaaggaggcgatgtttaagcagggaactgaatgacaggaagcagggagggttctgggtgtcataaaggggagtgaagaggttcgggggaggcagagatcatcaaggcagtctgtgtacttggagtgaagtgggtaaggggtgtggtaaatgaggctggggagacgggggctgttgttcacggtttgcgcattaagatgagttttaagtgtgaagggagccacaggagagatttaggccaggttaactttcagttgttttttgggaggctctttttattttattttattttttgagacagggtctcactttgttgcccaggctggagtgcagtagcacaatcacagctcaatgcagccgcaccctcctaggctcaagcgatcctcccacctcagtctcccgagtcgctgggactacaggcatgcaccaccatgcccggctaatttttgtattttttgtagagatggggtttctgctccatgttgcccaggctggtctcgaactcatgggctcaagcgatctgcctgcctcagcctcccaaagtgctgggattacaggcatgagccacggcgcccagcctaactttcagttttaaaagctcaccagggcttccgtcgagcttggttctaacgaggtgaggtgtaagggggcgcccctctatgccacaggcacacgagggcactgtcttcctgccatgtttctgtatccccaacacctagcacggggccatccacagagcagactcaggctccccatctgcgaaacgggggatttgatgcaaagaactcacagggccctgccggctccaatatagggtctatacaacagagcaggcggcaagagccaatcacggtgcagccccacgagtcctggcaactgattggctgctcaggaaggtgtcagttccgaaggttcaggtccatccctttgctgttaacccctcatggctggcagcatggggagccagctctcaggcttatctgatcttgtatctgcagcaggggcctccccaacccccagcaaacctaccatcctcagcccagaagctctctccaccttaatctcaggtgccagagatttggggctgcctgtttttcccaacccaccttctctccctcttccccctccaatgtcaagggcccagtgtgactattttaccctcccttcacaggggcacaggcattggcagtagcaggatcccgctctggggtctcgtctggggctgagaaactttgtgcctgaagccatatgagggtgtgaggcaggattcaccacagaacttgcaagacccagtgcaaaatggaagtacagggcccatgctcaaaaatgattaagaatttcaagatgtagacatcagagtattaaacaaggtgcaggacccttctgagcatggggccctgtgcaattggataggtggccacacgcatagagctggccctactgggataccttcacccaatccttcggagagacttgggaaggtagatctggtcgggcctatttctccagcttctgtgatgttgtccaggacaacaaagtccactaggggccaccagggatcagggacctccaggctgctgagagcacctggccataacctggcctcagcagcctcagccatccatctcaacgtacaagggaggtgcctggggaaggagcttgggacttccaagcctctacctcttatagaaaaggagattgaggctcagagaggggaagtgattggtccaaggtccttcagcaagtgggtccttcaactcagccaagatgcacaaaggcgggacaaggtctcaagccagcatccagagacccagggacagaggcagtgacaacacactgctggtgaccatggccttgagcaggagctgcctcacctaattctccctccctgctcaggtttgcagccagccctcccttggcacttagaggcacctgataaacgtttgatagttgatggtgagtgggcaggaatccttgttcccattttgtatataaggacaggaccagagaggggcactcaccagcatcaggaccgagctggggcaaaagcggctttctaggctctctgctagggtttccctgccctctcctggctgcctgccttcctctagcctgggccagggcatctaaggcagctgagcagagtgtcccggggagagacagcagcagagagagcccagcccacccaagtctggggttgggggttgggtagtgaggaatcctctggggtgggttggaagcatctcggctccaggctctcttctcccttctgcctgccctcctcttcctaggagagcctgatccctgcccctgaaaggggggttcattaagatcaagaaatgagggcccccgcgaggttctgcatggaccttggctctgaagctggacaggaccgtgtaagcctgggaggcaagcctcttagtggctgtgaggctcagcttccccatgggtgtcctgtgcatgctaatagccatctcccagggggatcaaatgagatcacacatgtgtgacatcttgcgcaggggccagcatgtggcaggcctttgctagatggtggctatgatcgatcttcctgtggtccttcccacgatgtccaagtcaggtcaactcaaaacacatgtgttgtgtgtaaggtaatgcatgtgtcataccatgtagaagacactgtgctgagataatgggagacccacaaagagctggccatggctccctgccctccacaggctcatagtcatgggagagatcagataaagtcactctggggagtggagaccccttcgtggtagatcagaaaggcttcccggaggagggggcactggagctgcgcctggaggctttagacaggtggatgtggggagaaaaagcactatggggagagagaacagcttgagcaaaggccctggggtagaaatgtgcagggagcttgtggcgaacagtagggtccggaggaggcagagtgtgaagcaaagtaatgggtaataaggccaggtgggaggttgagtgaaggccatcaggagccttgagtgccatgctagggagtcggggaaatgtcctaggagtgatggggacccctgagggctggccagggaggggctggtgcctccccagtcatccttccctcctgagtctgacaccaacacgctccctccacgtccgatgacagccctgcctccgcatcctgcaatagagcgcagggcctcccaggcctgcagacagctctgttccacccctcagcatgccttgtccccaggtgtccctgttccttggagtcaggctctctggatcacctcctccagcagcctgcttccgcagaagctcctctcccagctcctgctcttgcctgagccagccttctcctccacgtccctttgcttggaggcccagcctaaaggccacccctcctcccttctaccccttcctccataccccatcccgggttctgggagcccccagcacctctcagcgccagtgctgccttcttggctggactgtcaggcagctccactgggctggaggctgtgggtgcccacacagggtctggcccacaggaagtgcctgaaaggggggtcgacttggtgacggtctctcccctcctcccaccaccccacatatccccaggaactcacacggtggggatgtactctccgggaaaggcgttggtggtgtagctgatgagaaggcaggtcttgcccacggccctgaaagacaggaagtgcaagagggcggcggtcatgggctctgccggagacgtggggaggtttctgcctggtcctctgcaaagacctcagcatccacccagcctagccctctgggcctccgtctccccatgtgagatgccccctgtctgtgttctcacacccgagagcctgcaagtcatgtggatgtttgttaaagtggagacttcagggtccagccccagagattctgatccacaggtgtgcgcagagctggcaatccgcttttcccacaggcttctccaggggccagtgatgtgggacagagggtgcccagcagacccaggcaatgccgaggggcccccgacgcctgacctgggcttcaaatcccagctgtaccacctaccagtggtatgatcttggacaagtcacttaacctgcctctgcctcagtttctccatctagaaaatagagatgagcccatcctcataggagtgtgctgaggagtaaatccaacgaggcctatcaaagcactgagcacagggcctgatgcatggcagcagccgatggctgctagggaagacctgaccctgctcttccctctcacctcccccgtggagcagagcagttaccaggtcagggtttgagtcagagtggtctgggttcaaatcctgtgaggctttgggcaaattacttagcttccctgaactttcattttcccacctgtaaaatggacctattaggtttggtgagaggataaatagagaaggctagattaaccccagagctggtacataggaaggaagtgataacgcgcgcctcctccaccctcagcatgcgaggctgggagcgggtgcaggtagctcagccgaagcccagaggccaagggacagctctgggccttcccctgccctgcgtggttttgtcacttcctgctcagagaagacagctcatcctctcctcctaccatcgccctcccctgggcctgccaccgaggtaattttgaatgactggaacgttaacccttgacttccgcccgcccctcctccgatcagatacaaagcagaagtgaacagggctggggcaggcgagggcagataaggagccatgcatcagaatcagctgaggctggtggacaaatgggcccgcccccacctagatgggtcacagccaaagtcggggccacagggcccaggccaggagagctgagtctctcaaagccttgggctgctcctctgtagaatgggaaggctggacaggaggcccccttccagctagaacatgctccagggtgagcctgtaggctggaccctaagatgtggctgctggcaggcatgacagattgacaaattggacctgtccttttattttgtgtttttttaagagacagcgtcttgctctgtcacccaggctgactgcagtggcaccattatagctcactgcagcctcaaactcccgggctcaggcgattctcccacctcagcctccccagtagctgggactgcaggcgcatatgccaccactcctggcttaaaaaaatttttttatagacataggttctcgctatgatgcttaggctggtctcaagctcctggcctcaagcaatcctcccatcttggcctctcaaaatgctaggactacaggcatgagccactgcacctggcctggacctgtcattttacagatgaggaaactgaggcccccaggggacaagacagcctgaagtcactgggatctgacaactgagaagggtctcagcccagcctgcccctcccctgccgaccccacaatcaccctcccatcctttagcctcctccttccctctctgtctctcaatgtccccttgcctcttctgctcctcacccacatcccccacacatcctccccaacccggtaggctgaggggaggggagagaaagtggagggggtgctagaaggcacatactacaagcaagacagccactcagcttatctcaagcgaccccacagcatccccagggcataggcctcctcccagatgaataagctgaggttcagagaggtgctgtgacttgcccaaggccacacagcggcaccaagccagtgacgacagcccaggtcagcctggggacaaaggctgaatttcaggtttcccacttccctcctgcatccacagagtaaagactgaggcttgcctccgtgggagacctgcccccagcttttggggtgcaggtgaggagccctgggcactctcacccatagtcctgcaccctccaccgagatggcttctggggtggggtggggctgaagagggtgaagctcccctcagcccacccccgggtgctccctgtgggccctcggagaaggaagcgtcccctccaagctgccttccagggacgcctagttctgcagggccaggggcttccccaggggcaccagggcggaaggatctcagggcatcccagttgggggctgtgaggaagtccagccaggtacctacccatctcccaccaccacacacttgatggcctgcatcgtgtccggagcctggagagtgtcggtggtgacagctcagggccaggcgcgtttctgcgggcgcaaggggtgtggaggctggtgaggcgcctgctgaggagcagcggtggtggggca

SEQ ID NO: 1937 - DNA, 37030 bp, Homo sapiens
gttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgaggtgagtgtgtgaggcgcaggctgggccctccagagccgcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaagtgaggtttggttttcttaaaactttttttttgagatggagtctcgctcttccgcccaggctggagtgtagtggcgcgatctcggctcactgcaacctccgcctcccggattcaagcgattctcctacctcagcctcccgaggagctgggattacaggcccccaccaccacgccgccaggctgatttttgtatttttagtagagacggggtttcaccatgttggtcaggctggtctcgaacttctgacctcaggttatccacccgcctctgcctcccaaagtgctgggattacagccgtgagccacagcgcctggcccctgtttttttgtttgtttgtttgtttttaacttctaaagcgcaatgtaatatacatgtagaaaaattcacattcacaactgtatacaactccgtgaattattacaaaatatactggccgggcgtcgtgtctcacgtctgtagtcccagcactttgggaagtggaggcgggaggacgattgagcccaagagttcgagaacagcctggtcaagatagtgagacccgcatctctacaaataggaaaaattagctaggcatggtggcgtgcacctgtaggcccagctattcaggaggctgagaagggaggatctagcctgggaggtataagctgcagtgagctgtgatcaggccactgcactccaacctgggcgatagagcaagacaaaatgaatatacacctatgtaatcaccacttaatagaatggtcctcagaagccttcctgtgtagtatttaatattttcccctttttacagtggtaactgctatactggtttctaatgagatgaactaatgttgcttgtttttgaattttatataaaaatacatcaggagtgttgagtgtttcgttgtttcacatgcttgccaacacgatatttttcagcctttttgattttaactattctgctggttacacagtaatgtcttaatgtgattttaattttcctgattaataatgatgttggacatctgttcatatgtttttgcccattttgatatcttctgtgatgtgcttgttcaaatctcttgcctatttttctattatctttttcttactgatgtgaagttctttatatactggttatcagccctcagttatgtttgtgctaaatgttttctctactgtggtttgacttgtcactctcttagtggtgtcctttgatgaatagaagtgctgaatttatttttttattatttatttatttatttatttttccttttgagacagagtttggctcttgttgcccaggctggagtgcaatggcacaatcttggctcaccgcaacctccgcctcccgggttcaagcgattctcctgcctcagcctcccgagtagctgggattacaggcatgtgccaccacgcccagctaattttgtatttttctttaatagagacaggatttctccatgttggtcaggctggtcttgaactcctgaacttaggtgatctgcccgccttggcctcccaaagtgctgggattgcagacgtgagccacagtgcccagtagaagtgctgaatttaaatgtagttcagttttcagtcttttcctttttggctagtgcgttatgcatccagtttcaagaaatctttttctgtcccaaggttgtgaaaataataagtgttactttgtttttgacagacgattgtacatatttatgagatacaagatgatatttctttttttttttttttttttttgagacggagtctcactctgtcgcccaggctggagtgcagtggcgcgatcttggctcactgcaagctccgcctcctgggttcacgccattctcctgtctcagcctgccaccacgcccagctaattttttgtattttttagtagagacagggtttcaccatgttagccaggatggtctcgatctcctgacctggtgatccacccgccttggcctcccaaagtgctgggattacaggcgtgagccactccacctggcccaagatgatatttcaatacatatatacattgtataatgaatgatcaaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactgttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgggatcacaggcatgagccaccgcgccccgccaagatcaacttttttagattctacatatgagtgagatcatgcagtatttgtctgcaaacacatttataatgtataatggggtatataaaaataagtaaaacttggcccctacactgaaggaatataaagcaggagaacagagaggcacaataagagaatggccttggcttttcctaaagtctttttgatacgactagctagatagaagatggggagagagatgcaccttatttctctagtgtttatactgataagcatttgtatttttcagtaatggcaatgcagatgcagcttgaagcaaatgcagatacttcagtggaagaagaaagctttggcccacaacccatttcacggttagaggtatgtggttagttgctaattttggaattatatactagattcttctacctagtggaaggtattacaacctttacataaaatataggtttactaccaaggtcaagacccaaattagacttttcagaagtgttgtcaataatcctgtggaaaggctgcagatcattgctaaatatgtctggcagggcctcttcctttgtcaacaattctcttcctactttatcatttttatttctgagagttggactgtcagaaactaaggcctaggatcccatggtggaatctctgtgctgtttttgtttgtttgtttgtttgtttttgatggagtttcgctcttgttgcccaggctggagtgcaatggcgtgatctcggctcaccgcaacctctgcgtcccaggttcaagcgattctcctgcctcagcctcccaagtagctggaattacaggcatgagccaccacacccagctaattttatatttttagtagagacagggtttctccatgttggtcaggctagtctcgaactcctgacctcaggtgatccaccctctttggcctcccaaagtgctgggattacaggcatgggccactgcgcccagcctgtgctgtttttttgtttgttttttaagaaatgggtcttaactgtgttgaccatgttgatcttgaactcctggcctcaagcagtccacctgccttggcgtcccaaactgctaggattacaggcatgagccaccatgcctggccaaagcatcctgtgctatttgcactaagtatgaaagtgctgttctgggaattatagcggcctggaccagttatgcaaggaagacagggaagcaccttctctccattaacctagatttgtgctgtcagctgtcattggcagagagaagggtgtggtggtgttatggtataagagacaagctccaattcaggattctgcacaagaacattaagcaccagagctgaggccttacactatttctgcccattgtatagagactgccctgtgagtgcagctgatttgggctaagtaggaggaaagcagagaaagacttgattcttctgtctctttttttcatatttcccatctctgactaatcttcaagactctagaagttaggagtgcaaaaggctaataaaaaaaaaagactctagaagttacttaaatggatttgtgataaacatttgaaagttcagagtcataacttctggtgccatgagcatccttatactcaaacatgcatattgcttaaatattaatagcagacatggcttatgttggcaaactaatctctcccctcttctaaattctcccaacccctgaatgcacccacattcacctactaactcatgttttcccagaagtcatggttttggtggctaatgaaaccaaagctgacttgaatataggaagaaagaggtgtctttgggtggtttgttttgagaagaggtataaaagtccctgacaaaaagtagttttcctcactgttaatgtcagttgttagagcagagctttctggtcattgttcaacaaaaagtattgacaggccaagatagtgctctttatattctgagcagccttatctatttaccctaccatagtgtaaaaatacagttttttatgtgtgcttgatgtggaaagtgttgagcaacactgtcttaaagtggtcttgtagggcccaaggtctcagagatcatttagggtcacaaaaaaaggttgggagttactttttaattccaattgctaataggagttctttttaatgtacatggcttagtgctagtttaaaattattgattttgataatgaaaaggttgttaatttgttattaagtacctcatatatagggctcatttttcagcttttgcatataataacagtaggctctctgtatctccggattctgtatcagcaaattcaacaaactacgtatcaaaaattcaatcaactacatatcaaaaaaaagtatacaggaggatgtacataggttatatgcaggtaatacgccattttatataagggacttgagcattgttggattttgttatctgctgggggtcctggaaccaacttcccatctccccccgcccccccaaggatttcaagggacagttgtattacaagtcttcaagcacctctgtgaagtatgtaggacacataacatctgtgttagattagagaactaaagcttaaatttatccatggttttcttcatttgcagcagtgtggcataaatgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttccccatggttacattttgttttatgaacctatttcttcagtgtttatatagttacacagttttattgcctttacccttgaagttttatgtagtataaagcagattttttttttttttttttttttttttgagacggagtctcgctctgttgccaggctggagtgcaatagcgtgatcttggtctactgcaccctccgcctctcaggttcaagtgattctcctgcctcagcctcccgagtagttgggactacaggtatgtgccaccacacccagctaatttttgtatttttattagagacagggtttcaccacgttggccaggatggtctcgatctcctgaccttgtgatctgcccacctcagcctcctaaagtgctgggattacaggtgtgagccaccgcgccccaccgcaaatatttatttataaaattgtattttcacgtatcgattactgttagcgttagataaatttattggattactcaaatgaatatttgctgaagtggttgcttaattggaaataagggttctgagtccctaacagtatttttgttaaaagattgtcatattgactaagccagtaggggtccctaaagtctttctgttttcgctttttgggtatcagtttttgtgaatgaacaaatgctgacaggatcttttctttttgccttgcgagatcttggtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttccgggttcaagtgattgtcgtgcctcagcctcccaagtagctgggattacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcagcttcaaactcctgggctcaaggaattctcagcctgctgagtagctgggactataggcacatgccactagcctgaccatttctaccagttttgtctttgctaatacattctcctgtttttcaccaaaggaagtagtctatattccttgagctcccatggcttgttagtacttctcatattacccatcacatctacttgtactatagttattttgtatagtttatctttctgattaagttataagctctgtggaggcaggaatcagctcttctttttctccatatccttcagagtccctgggactatgtttcatacgaagtaagtgtctagtacatgtttgttgcactgaaatgacagtgagtatatgaattggccaggctggtctcaaaatcctggcctcaggtaatccgcccatctcagtatcccaaagtgctgggattacaggcgtgagccactgcacctggccgtgcaatgaatttttaaatgaaatattaagtatatagaaaagtttagagaataaactttcattgatttttcagctatttgttgattttttttcttcatgggaaatttaaacattatgaaagtttaatctttttactttctatgggtctatttagattttcttcttgagtgagttttggtagtttatctttctaagaatttgcttatttcatctaagttacctaacttgttgacatagagatgctcacagggtttccttatactactttttatttacataaagtcagtagtaatgtcccctctttcattcttgattttagtaatttgagtcttttctctttttttctcgggcaatgcagctaaaagtttgtcaattttgttgatattttcaaagaaccagcttttggtttcattgatttttctctattattctgccctctacttaatagtttctaccctaacctgtattatttccatctttctgcttgctttgttttgtttgcttttctttggaaggttaggttatgatttatcttttttatttttagaggcagagtcttgttctgtcacttacgttggagtgcagtggtgtgatcatagctcactgcagcctccaactcctggctcaaacaaaccttctgcctcagcctcccaggtaactaggaccacaggcacgccccaccatgccctgctatttattttattttattttatttttgagacggagtctccctctgtgcccaggctggagtgcagtggcgtgatctctgctcactgcaacctctgcctcttgggttcaagcgattctcctgcctcagcctcctgagtggctgggattacaggcacgtgccgccatgcccagctaatttttagtagagacagggtttcaccgtgttagccaggatggtcttgatctcctgacctcatgatctgcctgcctcagcctcccaaagtgctgggattacagtcgtgagccaccgcgccaggccttttttttttttttttctgatgcagtctcactctcttgcccaggctggagtgcggtggtgtgatctcggctcactgcaacctccgccgcccgggttcaagcagttctcctgtttcagcctcctgagtagttgggactacaggcgcacgccaccacgcccagctattttttgtatttttagtagaaatggggtttcaccatattgggcaggctggtcttgaactcctgacttcgtgatctgcccacctcaccctaccaaagtgctgggattcaggcatgagccaccatgcccagccatgccctactaatttttttttttttttttgagatggaatctcgctgtgtctctcaggctggagtgcagtggtgcaaattcagctcactgcaacctccgcctcccagattcaagtgattcttccacctcagcctcccgagtagctgggactacaggcgcgtgccaccacgcccggctaatttttgtatttttagtagagaggaagtttcaccatgttggtcaggctggtcttgaactcctgaccttgtgatctgcccacctcagcctcccaaagttctgagattacagaggtgagccaccacacccagccaccctgctaattttaaaacatttttagagccagggtgctgctttgttactcaggctggtctcaaactcctggcttccagcagtcctcccacctcagcctcccaaagtgctgggattacaggtgtgattcaccacacccagccttcttttctaatatagctgtttatagctatgaatttctctctaagcactgcttttcttggagcccatacgttttggtatatcttcgttttcattcattgcaaaaacattttctgatttcccttgtcatttcttctttgacttgttgcttatttaggagtgtgttgctttatttttgcatatttgtgaatgcacttacttttcaattttagaatcaacccatagtgctattacagaacacttatctgtaattacaaaatagaatgtgaatgttctcagccagacaatatgaaagaaaaggtacagctgatagaggtggggaagtagccatggagagagaaaagattgaagggcaaatgtcctcatttttacaaagtaggaagttaagggatacagtctgcggttgatggagcaggaaatgaaggtgtactgtattgtcatttttgtcataaattgggcaaaacacatatgtacggatctctaatagttttttgttttgttttgttttgttttttgagacagagtctcgctctgtcccccaggctggagtacagtggcgcgatctcggctcactgcaagctccgcctcccgggttcacgcctttctcctgcctcagcctaccaagtagctgggacttcaggcacccgccaccacgcccgactaattttttgtatttttttagtagagatggggtttcaccatgttagccaggatggtctcgatctcctgacgttgtgatccgcctgccttggccttccaaagtgctgggattacaggcgtgagccatcgcacccggccggatctataatagtttttaaaactatattaatatattaacttgaattggcaatttaaaaattgatcttcatggaatctctgaattagattatccttttttatgactttctaaagagaaatcatcctggtaattttatttgatattttctcttcccattgcacaccttgttttactaatatttcttttttctttatatatatttttttgccatcaagatcactgtggtaaggaatattattttgttgatttaatatttcttatttttcccaggctgaggcagctaaattagttccaatgggtttcaccactgcaactgaattccaccaaaggcggtcagagatcatacagattactactggctccaaagagcttgacaaactacttcaaggtgtagtaatcctttatcctgtgttgtgaactctagttaggaaagcttccaggttataaaacaaaactgaaatatttgtgtagcatttccttgttagataatgataaagagatagaggaaggccaggtgcagtggcttatgcctgtaatctcagcactttgggaggctgaggtgggcagatcacctgaggctgggagttcgagaccagcccagccaacatggagaaacctattaaaaatacaaaattagttgggcatggtggcacatgcctgtaatccctgtaggtgcacatgcctactcgggaggcagaggcaggagaatcacttgaacccggaagacggaggttgctgtgagccaagattgtgccactgcactccagcctgggtgacgagcaaaactctgtctcaaaaacaaagagagataaaggaagtatccacattgaagaggtaagactgctgcaaggtaggaccttatttataaaatactaaacttatctgcaaattaaataatttagtctccatttaatattgtgttaagagagtaagctccttttgcttaaggaggtaactgtaattataacctactctaccacagggttgaaaacctgatgactggttaaaacattccatgtttgaatactactcattgtgtacacactaatcttcaggacttcagggaaaactataaagcttttgaccttattatttatttttcgagacagggtctcactctgtcacccaggctggagtgcagtggcatggtctcagctcactgcaacctctgcttcctgggctcaagtgatcttctagcctcagtctccccaagctaggactatgatcatttaccacctggctaattttttttttttttttttttttttttgagtcggggcatcactcattatgttgcccaggctggtctcaaaatcctgagctcaagccatcctcctgcctcagcctcccaaagtgctgggattataggcttgagccaccttgcctggcccaatgtcagttttctttcccttttttttgagacagagtctcactctgttacccaggctggagtgcagtggcataatctcagctcactgcaacctccgcctcctgggttcaagtgattctcctgcctcagcctcccaagtagctgggactacaggcaagtgccaccatgcccagctaatttttgtatttttagtagagatgaggtttcaccacgttggctaggttggtctcgaactcctgacctcagatgatctacccgcctcagcctcccaaagtgctgggcttacaggcgtgagccatcatgcctggcccccaatgtcagttttctaatatcagtgctatactatcattatgcaagaggttaacactgcagaaggctaggtgcatagaaatttcgtatgtttttttttgttgttgttggtttgtttgtttgttttttaaagacagagtcttgctctgttgcccaggctagaatgcagtggcacaatctcggctcattgcaaccactgactcccaggtttgagcagttctcctgcctcagtctcctgagtagctgcaatgacaggcacccgccaccgtgcctggctaatttttgtatttttagtagagacgggatttcaccgtcttggccaggctggtctcaaagtcctgacctcctgatccatccacctcggcctcccaaagtgctgggattacaggcatgagccactgtgcccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagcctccgcctcccaggttcaagtgattctcctgcttcagcctgctagtagctgggattacaggtgcccatcaccagttccagctaagttttgtatttttagtagacatgaggtttcaccatgttggccaggctggtctcgagctcctgacctcaggtgatcagcccgcctcggccccctaaagtgctgggattacaggtgtgagccaccgcacctggccttatttgcagctatctataaatctaattatttcaaaatacttttggtttatttgtttgtttgtttgtttgttttgaaacagggtctcactgtgtcacccaggctagagtgcactggcacgattttggctcactgcaacttctgcctcccaggctcaagtgatcctctcaccttagctcctgagtagctggtactacaggcatccgccaccatgcccggctaatttttgtagagacagggcttcaccatgttgcccaggctggtctcgaactcctgaactcaagcaatccacccacctaagcttcctaaagtgctgggattacaggcatgagccaccacggctagcctcaaaatacatttgtgaaaaattatcgcttgttggaaattgaatttttaacttacataaacatctttctgatgagctccaagaacatttctatgactacagtttctacatgtttgtattatgctaagagttatttcttatcgcttttttaggtggaattgagactggatctatcacagaaatgtttggagaattccgaactgggaagacccagatctgtcatacgctagctgtcacctgccaggtgagctgttggggctatagctaatcaaataagcaagcattacttcattcctgctatttgcaagcatctgttaggatggccataaaaggtactttctctgtcctcaagaatcttatagctgttaatagttagaagatagactcctacttcaaaatccttccatgtcatagaaacttccaaatcattgatctcctatcagatacgttaatttcaaatacttttgctaccaggccttttcctggctttacttgctactttttttttttttttttttttttgaggcagaatctcgctgtgtcgcccaggctgaagtacagtggtgtgatctcagctcactgcaacctcctctctggttcaagtgattctccttcatcaacctcccgagtacctgggattacaggcgcccaccagcatgcccggctaatttttgtgtttttagtagagagggggtttcaccatgttggccaggctcctcttgaactcctgatctcaagtgatccacccaccttggcctcccaagtgctggaattataggcgtaagccactgcgcccagccctccatcttcttcattagtctagattttatgattcatcattaaagtaattctcttgcagatagcctcagtttacatacccacttgaagagatgccaaccttagatgaaactcatctatcttctcagtgtctgtacccaaatagctgattatactggagaaaaatcgtatcatacagctgactgacttcactttaaattcaagatgacaggccaggcacggtggctcacgcctgtaatcccagtactttgggaggccgaggcgggtggatcacttgagatcaagagtttggctgggcgcggtgactcacgcctgtaatcccagcactttgggaggccgaggtgggcggatcacaaggtcaggagattgagaccatcctggctaacacagtgaaaccccatctctactaaaaatacaaaaaattagttgggcgtggtggcgggtgcctgtagtcccagctacttgggaggctgaggcaggagaatggcgtgaacccgggaggcacagcttgcagtgagccgagattgcgccactgcactccagcctgggcgacagagcgagactctgtctcaaaaaaaaaaaaaaaaaaaaaaaaaaaaagaagaagaaaaaaaaaagatcaggagttcaagaccagcctggccaacatggtgaaaccctgtctctactaaaaatacaaaaattagctgggcgtgttggcacgtgcctgtaatcccagttacttgggagactgaggcaggagaatcgcttgaacccggggggcagaggttgcagggagctgagatcgcaccattgcattccagcctggtcaaagaagcgagactctgtctcaaaaaaaaaaaaaaaaaaaaaaagaatgaaaaaaggaaaaaaattcaagatgacaaaactttagattaacattcaaaacttcttggcagtctactttctccatttaggtgtactttcccactgagttagacaggcatctcatatctcatacttcgtcttctgttatcagaactttatgctcctcttcaactctcattcttagccaaaaacctaacctgctctttgcatcaaatctacatttgtgcccatcttttcttatctcaggttacaattgagaaagtgtcccttttcttctcaaaggcccattctatcaatatgatttggttaccatctcctgccaccttctcaaggactctactccttccattttctcttgtacctctctatgagattatcctcatcagtatacaaatatgtctagtgtctcctccattaggaaaaaaccttccctggaccccttcagtttctttttcctttacttatgctcctattggtgggaagatttggaaatagacacagtaggttaaataattgcccaatacattgtatttaagtagcaaatactggactcaaaccagacttcagagatgatgttcttaaaacttcataagaggccagcatggtgtttcatgcctgtaatcccagtactttgggaagccaaagtgggaggattgcttgagaccaggaatttgagaccagcctgggcaacatagtgagaccctgtttctgagatgccatttctaaaaacaaacaaacaaaaacagacaattaaaaatattagcccagcatgatgatgtgtacctgtggtcctagctactcaggaggctgaggtggtagaatctcttgagcccaagaggtcgaggctccagtgactgggatcgtgccactgcatgttttctgctgtattgctagtgcctaaggcagtgtttggctctcagtaaacaataaatgcttgaatgagtggagataatagatgtccaaaaacatgcctgatatataaaatgaatgtcacagaggaaatgggttagctgtttaaggaatagaaaggggtaatttcaccctagagtgatcatggaatactttatggagaaaagattttggaccagacttctgaagaatgctaaatttgggaaggaaggaaattaaaagcatttaactgtatagaatgggatgaacagaggatgggaaggcataagttagaaggaaaagacaataaataagcaaggtcatttaactggtttagagtttgtgtagaaaagttgtaggagatgacccttaaaaagatacatcaaactgggcatgatagctcacacctgtaatcccagcactttgggaggccacggtgggtggatcgcttgagctcaggagtttgagaccagcctgggcaacatggcaagaccctatctctacaaataatataaaaattagccagacgtgggctgtgcctgtagtggcagctacttgggaggtggaggcgggagaatcgcttgagcccaggaggccaaggttgccatgagccaagattgtaccactgctctccagcctgggcaacagagcaagattttgtctccatctcaaaaaaaaaaaaaaaattaagatcctatttcagaaggttaagaagtttaaacttgattttatgaagagtaagcattagctggtcaggaaactaagatagtgacaataaagagaagtagggaaaagatgttgtaaagggcagcgcttgatgactgacaataaaaaatacacctcagcccaacaatgtattacagtaacttagtaaacctaaaaagtgtttgagaggggaagacagttttgttggaaacatgagtacaggtttagagatgacaggtttgaggtgacaaaccccgagtgaaaatttctagctgtattgagagatgtggaactaagtcacacagagaagtaaaaatggaatctggaaacgaaagatccatgagaaaggaagggagtaggatatagaagagaaagctaacaaactttcatcttttctgcaacttcaggcagtgtaatggggagccgtttttccttgtctaagtgagtcttaatgttctctggctttaaggatgtgctgcataagtggccagtccacaaagtatccttgaacctggcccatgcccatggaccaactcttctgttataatcttttgaagctttattataattttagttattttgaaaaacatggcattattttaatctagatagattatacccacttctgccatgggcacaacttactgttggagatcaaaacaactgaaacaaaatctgccttatatcagtgttacagaagaggcttcctagtgtttttctatcctcgggactcaactctgttgagtttttttttcttttcttttctttttttttttttttttttgagaaagagtcttgctctgttgcccaggctgtagtgcagtggtgtgatcttggcttgctgcaacctctgcctcccaggttcaagccattctcctgcctcagcctcccgaatagctgggattacaggcatgacggccaccacgtccagctaatttttgtatttttagtagagacgaggtttcaccatgttggccaggctggtctcaaactcctgacctcaagttaatctgcccgccttggcctcccaaagtgctgggattacaggagtgagccaccgtgcctggcccaagtttatttaaatttaacatcaagtaacctagcttgatagcctcccatttttcttattttcctttttttttttttttttatttgagacggagtctctgtcgcctaggcaggagtgcagtggcgcaatcttggctcactgcaacctccatctcctgggttcaagcagttctccagcctcagcctcccaaactgggattacaggtgcctgccacccaacacagctaattttttgtatttttagtagagacaaggtcttgctgtgttggccaggctggtcttgaactcctgacctcaggtgatccacccgcctcagcctcccaaagtgctgggattacaggtgtgagccaccatgcccggctttttgttgtcattttaattgtttattgctccactgatattttctttgcagaccaaaatgttacaatttttttttttttttttgaggcggagtctcattctgtcgcctgggctggagtgcagtggtgccatctctgctcactgcaagctccgcctcctgggttcacgccattttcctgcctcagcctcccgagtagctgggactacaggcgcccgccaccacgcctggctaattttttgtatttttagtagagacaggttttcaccgtattagccaggatggtctcgatctcctgaccttgtgatccgcccaccttggtctctcaaaatgctgggattacaggtgtgagccaccgtgcctggctggctgccatatgtcttatgagacagccaagctagcatgtcagtatcgagtagacctaatccattgttaactctcctcagaaataaattcttttttttttttttttttgagattgggtctcactatgttgcaccggctgttcttgaactcctgagcgcaagcaatcctccaacctcagcctcccacatagctgggattacaggtgaatgcctctgcacccagatcctcataatcattaggaagaaagagctgagggggaggggtggaggaggatgcttaggagaccttttatgataataagggaggaaacattgagaagaggaagagtaagttatagaagctatagctattgcgtgagctccattagaaatttgatagctaaagggaattagggctgtttaaaatgtcactcttacatccgtcatttgacatgatatgtgacctttttaaatagaaatgttttcccatgttttgacagggacttatgtagaataagtatttagactacagtacataatatctatagttgccatggcaactcagcatagcatgctgacactccaaagttgtacaaatagaatcctaatctgagaatgtttaagtagtcagataatgtctgtcaacaataaactaaagcaaaattctcaagtaaatatagcctgttaaaataacatttacagatggctgaacaactatatagatcgttgactttttttaaagaaaaagaatgctaattaattaataatagaaaagattacatttcatcagcctaagagctggaaccagggatatagagaggatgttagactattacttaaatctaaatattatctactctcatttgttttctcaatttaatgaagtaaaaccccattatatgttaggtctctctctaatagaaaagtcataaagttgagagctacagttaggttacaaaatgaattagcccatgcttgttcaaagtactgcagtagttttaaaattctgggccgggtatggtggctcatgcttgtaattccagcactttgggaggctgaggccggaggattgcttgaacccaggagttccagacaagactggggaatatggcgagatcccatttcaattaaaaaataaaaacagttctgagaagacaatttaacataagtaccagttttaaaagcacatgcccatgcgggcatggtggctcacgcctgtaatcccagcactttgggaggctgaggtggatggatcacaaggtcaggagttcaagaacagcctggccaagatggtgcaaccctgtctctactaaaaatacaaaaattagccaggcgtgggggtgggcgcctgtaatcccagctacttgggaggctgaggcagagaattgcttgaacctgggaagtggaggttgcagtgagctgagatcgtgccactgcactccagcctgggcaacagagtaagattctgtctcaaaaaaaaaccaaaaaccaaaaaaccacaaaacaaaaaaatcacataccctttgacagaaaatttgtcttacagaacatttcacatatatgcaaagataaatgtacaaataatttataccaaagcataattaaaatggtaaaagttagaaacatactgcatcactataaaatgagaagtgttaaattatgctcctaagcagttattaagaagagctaacctgatggtatcccaatccagtaacagaagatggctatgatggcactgggagggcaaggtagaaagggccaaataagctggagaacagagcatgcaatccatccccatgatcttaccctgggagcttgtccactatcctgttgtcagtctacctacctattcccaatcatctgtggcctttcctttgccaaggaagtctattcaattggaaaagaatcccctgtcatgttagcacttaatattacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaaggttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactggagtgcagtggcatgatatcgctcactgcaccctccgcctcccaggttcaagtgattcttgtgccccagcctcccgagtagctgggattacaggtgtgcaccaccacgccccactaatttttgtatttttagtagagacagggtttcaccattttggccaggctggtctcgaactcctgacctcaggtgatccactcgctgggattacaggtgtgagcccccatgcctggcctctctacttctttttttttttttttttttttgagatggaatctcgctctgtcacccaggctggagtgtagtggcacgatctcggctcactgcaagctctgcctcccaggttcacgccattctcctgcctcagcctcccaagtagttgggactacaggtggccgccaccacgcccggctaattttttgtatttttagtagagacaaggttttaccatgttagccaggatggtctcggtctcctgacctcaggtgatccacctgcttcggcctcccaaagtgctgggattacaggcgttagccactgcgcctggcctccggccctctacttttatattgtttagatttttaatataagcatatagttgttttgtaatttcaaaaaaaaattctcaaagataagaaagaaaatttgggctgggtgcagtggctcacgcctcccagcactttgggaggccaaggtgggtgaatcaccttaggtcaggagttaaagaccagcctgaccaacgtggagaaaccccatttttactaaaaaatgcaaaattagccgggcgtggtggtgcatgcctgaaatcccagctacttgggaggctgagggaggagaatcccttgaacccgggaggcagaggttgtggtgaggcaagatcatgccattgcactccagcctgggcaacaagagcgaaactccgtctcagaaaaaaaagaaagaaaaaatttggttctcctaggcctttaacataaaatgttctaaaggattttcctcataatttaaatgggaattatgactccaaagtagatttctagagtagaaattaccctttagcatcattcacttaaactttgtagaaaaattcaaaggtatctggtatggaatgggtagtctaaagcagagatttccttgagtggctcataagacagttttcatggcatttcatttacttctcttttctttcctttttgttttctctttaaaattctttctacttatttttctgttttctccaattgttcattttaaacatcttgtttatactattggagtaaatatgtttttttcttctttcttgctcacactcgaaatttgctatagacactccgagggcattgactagtccctttagtacccctaaagaatgaactgctcaataaagtgaagtataagtttgatatagacatgctaaaattaactgggctttggatcatggcccattattgattaaagctaaggtaaatggtcttccaagtttctgtacttttgaattgatcagtcttgtgttggtatgcagttctagaattttattactggccaggtgtggtggctcacgcctgtaatcccagcactttaagaggccgaggcgggcagatcacttgagtccaggagttcaagaccagcctgggcaatgtggcaaaaccctatctataaaaaaatttaatcgggtgtggtggtgcacacctatggtctcagctatttgggaggtgagatgggaggatctccagagcccggaaggcagaggttgcagtgagccaagattgcaccactgcactccagcctgggcggcggagtgagaccctgtctccaaaacaaaaaaaggccaggtgcagtggctcgtgcctataatcccaacactttgggaggccaaggcaggcagatcacctgaggtcaggagttcaagaccagcctagccaacttggtgaaaccctgtttctactaaaaatacaaaaattagctgggcgtggtggcatggacctttaatctcaacaactcaggaggctgaggcaggagagttgcttgaacccaggaggtggaggttgcagtgaaccgagataacgccactgcactccagcctgggcaacagtgagactatcgcaagaaaaaaaaaaaaaagaagaaaagaattttattacctactttgggctatatttctaagcagtccagttctgacaggactagctgtatgtactgagacacaatcagctttacatatttttctagctgtatttctattaatatcagaagggaatgcctccttcctaccactgtcatttttaaatgtttttttccctttgccttggaggaattataaagatgtcatgaggagcttggtcagctgtatcagaaatacaatgttcatttctactgttgtttttgttctctatagcttcccattgaccggggtggaggtgaaggaaaggccatgtacattgacactgagggtacctttaggccagaacggctgctggcagtggctgagaggtaggttactggtttagataagagagactatggctacacttatcaatgtagtgattgccagggttagtttggccgaagaatgtctcttctataaccccacgtcccaaagttgtatgtgtggttcaaaagaatgacttccttagtagaaaaaggcattcttttttttttttttcttcagatggagtctcgctcttgtcacccaggctagagtgcggtggcgtgatctcaggtcactgcaacctctgcctcccgggttcaagcaactctcccacctcagccttcctagtagctgggattacaggcgcacaccaccacacccagctaattttttgtatttttagtagagatggggtttcaccatattggccaggctggtctcagactcctgacctcaggtgatccacctgccttgacttcccaaagtgctgggattacaggtgtgagccaccgcacccggccagaaaaaggcattctttagagttgctgtcagactggatttaaaaaaaaaaaatccaactatatgttttcttccagagaaaccctttagaaagtaaaagaatggagaaagatattgcatgcaaatagtaaccataagagacactgcgtggctatactaatatcagacaaagtacactttaaggcagacacattggctgggcgctgtggctcacgcctgtaatcccaacactttgggaggctgaagcgggtggatcacgaggtcaggagatcgaaaccatcctggctaacacagtgaaacctcgtctctattaaaaatacaaaaagttagccgggtgtgttggtgggtgcctgtagtcccagctactcgggaggctgaggcaggagaatggcctgaacccgggaggcggagcttgcagtgagccgagatcgcgccactgcactccagcctgggcgacagagcaagaatccgtctcaaaaaaaaaagacaaacacattatatacaaagaggaacattttataattaaaaggtcagtttgtcaggaagatataacagttgtaaagatacacacacgcctaacaacaaaaccccaaaataacatgaaacaaaaactgaattaaaggggaaaatagacaactcatcaataatagtaagggaccagtttttcattttcattaatggatacaggcttcaatatttcactctcaataatgaatataacatgtatcagaggccctgctaaagggcatctgtgaaaaacctacaggtagcatcatactaaatggtgctctgttacccaggctggaatgcagtggtgctatttcggctcactgcaacttccacctcttgggttcaagtgactctcctgcctcagccaaaaattagcctggctaatttttgtatttttagaagagacagggtttctccatgttggccaggctggtctcaaacctgacctcaagtgatctgcctgccttggcctcccaaaagtgctgggattacaggtgtgagccactgcacccggccttaatggtgaaattctgaatgcttttccccctaaagtcagtaacaaggcaaggatgcccactttcactatttacattcagcaatgtaccaaagattatagacagtgtagtcagacaagcagatgaaataaacggcatccagattggaatggaagaaggaaaactatttgctaatgacatggtgccatatgtagaaaatcctaaggaatccatccacaagaaaaactagaactaaataactgttcagcaaagttgcagaatacaatatcaatatacgaaaatccattgtatttgtatatactagacaataacaattcaaaagtaaaacttgaaaaaaaaacttcattcacagtagcaagaaaaagaataaaatacttaggaataaatttaacaaaagaaatgtaagatttgtacagcaaaaactctgaaacattactgagaaaaattgaagatttacataaagagaagcattccacatcatggatgggaaaactcaagattactaaaatggcattcttggccaggtactgtggtgcacacctgtaatcccaacactttgggaggccaaggtgggcggatcacctgaggtcaggagttcgagaccagtctggccagcatggcaaaaccctgtctctactaaaaatacaaaaattagccaggcatggtggcacactgcctgtagtctgagctacttgggagggtaaggaaggagaatcacttgaaccagggaggcagaagttgcagtgacctgagatcgcgccactgcactccagcctgggtgacaaagcgagactctatctcaagaaaaggcagttctcctcagattttatctatagattcaacccaatccttatcaaaattccagcaagctttttttgcagaaatttacaaagtaatcataatatttatggaacataacgtggaaatgcaaaggacccagaatagccgaaatgtctggaaaaaaaagaaaatttgaggtcttagactttttggtttaaattcttattataaagctacaataaccaagacaatatggtgatggcatatggataaatatggagagttcggaaatgaaacctttatggtcacttcatttttgacaaaggtaacaggcaatttttttaaaatttaaaattttttacaaatacacgtggtctcgctgtcttgccctggctggtctcgaactcctggcctcaggtgatcatccctactcagcctcccaaagtgttaggattacagatgtgagccactaaacctggctgacaaggcaatttaatgagggaaaaaatggtcttttcaataaacagtgctgatgtagatgaatttccaaatgcaaaataactttagacccttactatataccacacataaaaattaaaatagataacagtgtggtcattcctcaaaaaattaaacacagaatgaccatgtgatccagcagttccatttccagctatataaagaattgaaaacaggaactcagatacttggacagcgatgttcatagcagcattactcacaatagctttggaaataacccaatgtccattgacaaatgaatagataaaatgtacatacacacaatgaaatatcattttagccttaaaaggaagaaaacacattttttttcttagacctagtcctgcagataaaaaggtaggaaattctgacacatgctattaacatccactaaccttcagggcattatgctaagtgaaataatttagtcacaaaaggacaaaaactgaggccaggcgtggtggcttatgcctgtaatcccagcactttgggaggccgaggcaggtggatcaccttaggtcaggagtttgagaccagcctggccaacatggtgaatccccgtcactactaaaaatacaaaaaattagccaggtgtggtagcacagacctgtaatcccagctactctggcggctgaggcaggagaatcgcttgaacctgggaggtggaggttgcagtgtgccgagatcatgccattgcactatagcctgggcaacaagagcgaaactctggctcggggaaaaaaaaaaaaaaaaggacaaaaactgtatgattccactaacatgtggtacttcaaaatcaaagagacagaaagtagaatggtggttttctgggggtagggagactggggagttgttgtttaatggtacagtttcagtttgggatgatgaaaaagctctggagatgaatagtggtgatggttgcacagcagcatgaatgtccttaatgtgcctgaactgtatactttaaaatagttaaaatgctcaatttaatgttatatgtgtacgttttactatactgtttttagaagggtgatagtcctaaataagagcctaactataatttttcagagagaacatgggagaaaatcttagtgaccttggggtaggcaaagatttattagctacaacaccaaacacacagtccatgaaagaataaattgataatagagttagttttcacttcatcaaaattaaaaacttctgtgcttcaaaggacactatgaagcaagtgaaaagataacccaaagaatgtgagaaaatatttgcaaattacgtatctgataaatgtctagtatctagaatatataaagaactattataacccaacaataaaaagataacccagttgtttaaatgggcaaaggatttgaatagacatctctccaaagaggatatacaaatggttgatgagcacataaaaagatgctcaacatcattagtcatcaggaaaatgcaaattgaaaccatggtgagctaccacttcacacccactatgaaggctataataaaaaagatggtaacaaatactgggaggatgtagagaaactggaaccctcatatactgctggtgaaaatatacaacggtggtctctttgcaaaataggtggcttcttaaaaagttaaatataaatttaccatatgatgcagcaatttcactctagttatataccccaagagaaataaaaacatgtctatacaaagacttgtatgataatgtttatagtatcattataatagcccaaaatgttcatcagctggtaaatgaataaacaaaatttgttttctccatacaatgggatactcttcagcaataaaaaagaacttaagtactgatacgtgttaacaacatggatgaggtttcaaatatgctaaatgatagaagttaaacacaaaagaccacacaatgtatgattccatttatatgaaatttccagtaggggataatctaagggatagaagaattgtggttagtggcgataggaatgaggaataactgtgaatgaagttgagagattttttaggggtgatgaaaatgctctaaaattggattgtgttcatggttatacaactctgcaaattcactaaagctctcaatgaattttatacttacagcaggtcatttttgaggtatgttaattatacctgagtaaagctcgtgaagagtttgtaagtttctatatcaaataaagtttttaaatacatcctcaaaactgtttcacttcttttcctttgtctagggtcaaatgtggtaatttagtccctgccacacattttatggaaacccagtgataaaacaatttaattgtctgctgagatgtcagactcaagttggaacctgcctaaatgaggagaatattctctctcgttttataatcgaattatctttcccagcttataatttgagaactgcaacctattgaatgtataccactgaagcataaaattaggttggaatggtaattgcagctttttgtctctgcctacaaaattcctatgaaggaaaaggaattactcttttgcagtctgatcttagttttctgaggatgtatatacttaattgtgtcttccctctcaaaattgttttggcaatcatgtacagcattcatacttttaagtatactgttttagtagtttaaggattagcttttggacagagtcactaaaacattctcttgtaacataaataagtattcagataggatagatgacctagtagaatataggctatgaggacaagaactttgatttggtcacctattggatgcccaagcagtagagcaatgcattcaggatttgttaatgaatattttgctgacaaaaaattttttgttgtttgtttttttagagacgggtctcactctgcccccactagaatgcaatggtgcaatcatagctcactgcagcttctaactccagggctcaagcagtcccccctcctcagtgtagctgggattacaggcacacaccaccaagcccagctaatttttttatttctttttttttttttttttttttttgagacagagtctcgctctgtcgcccaggctggagtgctgtggtgcgatctcggctcacgcaagctccacctcccaggttcacgccattctcctgcctcaacctcccaagtagctgggactacaggcttccgccaccacacccggctaatttttttgtattttttaattttaattttttttaattttttttaatttttttttttttttttttttgagacagagtctcgctctgtcgcccaggccggactgcggactgcagtggcgcaatctcggctcactgcaagctccgcttcccgggtccacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcctggcctatttcttatttttgtagagatgaggtcttgctgtgttgcccaggctggtctcaaactcttggcctagagtgattctccctcctcggcctcccaaagtgctgagattacaggcaggcataagtgactgtgcctcgctgaaaaatatgtttacatagaaatttcattaatttgttttaatcaggtctctttatcaagaaaaaaattttataattgaattatatttctgagaatgtcacaaggcctccttaagctaataaaaatagccctctttcattcacaacaaaagagcccttactgattaatttttgccgtgccctgttgaagaatattagcccacatgcatgttactgtagctctggggttcccagaacatggtccccagaacagcagcattatcattacttgagaacttgttagaaatgcaaattgtctgatgggacttcagatctactgaatcagaaacaatcagatactcgggctagcaacctgttttaacaagctctccagggccagacacggtggctcacgcctgtaatcccaacactttgggaggccaagggagtggatcacctaaggtcaggagtttgagaccagcgtggcaacatggtgaaaccctgctctactaaaaatacaaaaactagctgggcatgttagcgggcacctgtaatcccagctactcgggaggctgaggcaggagaatcacttgaacccaggaggcggaggttgcagtgagccaggatcgtgccactgtactccagactgggcgacagagtgagactccatctcaaaaaaacaaaacaacaaaaaaaaatgcaagctctccaggtaatctgatgcttgctaaagtttgaaaaccatgaccacaattgctagcctttcttgaaagtctgaagtactgtgaaagaatgacagaactcctttgagatgagcttagtttttcaaacttatatgttaagaataacctgaggtatttgttaaatatacagattaccaggctcttccctgataattgtaattcattgagtctaggttaggcccaggaattttttttttttttttttgagacggagtttcactcttgtctcccaggctgccaggctggagtacagtggcgtgatattggctcactgcaacctccgcctctcgggttcaagcgattctcctgcctcagcctcccaagtacctgggattacatgcgtgcaccaccacacccatctaatttttgtattttttaagtagagatgggttttcgccttgttggcaaggctagtctcgaactcctgacctcaagtgatccgcctgccttggcctcccaaggtgctgagattacaggcatgagtcaccacagcctgcccaggaatttgttttctaacgggtgttccaggttattatctttaaggaagttcaagaaacactatgaaagaggatgctatggccgggcgcggtggctcatgcctgtaatcccagcactttgggaggccgaggcgggtggatcacaaggtcaggagatcgagaccatcctggctaacatggtgaaaccccgtctctactaaaaataaaaaaattagccaggcgtggtagcgggtgcctgtagtcccagctactcgggaggctgaggcaggagaatggcgtgaacctgggaggcggaacttgcaatgagccgagatcgtgccactgcactccagcctgggcgacagagtgagactccgtctcaaaaaaaaaaaaaaaagaggatggtatttccagccaacttgtcccaagctgtgggaattccatgtcctgcttctggagcctaagcacagaggttcccatagttttttttgtgagtgccgctgagagaaaagctaggataactctttattctggtaaaccttctctgtttttatagcaaatagataatctccctttcttttttaatttttaatttttttttaattttataaatagagatggggttttgccatgttgcccaggctggtctcaaactcctgagctcaagcaatcctccccactcagcctcccagagtgctgggattacaagcatgagccaccgtgcccagccttttctccctttctgatagtagattatatcagtgtatttttttgttcgtttgtttgtttgtttttgagacagagtcttgctctgtcacccaggatggagtgcagtggtgcgatctcggctcactgcaacctctgcctcccggtttcaagcgattctcctgcctcagcctcccaagtagctgagaagcagggattacaggcgcctgcaaccaacccggctacattttgtatttttagtagagatggtgtttcaccatgtagtctaggctggtctcaaactcctgatctcaagtgatctgcccacatcagcctcccaaattgctgggattacaggtgtgagccactgcgcccagccatatcagtgtttcttgaggcagaactagaagacttgtgcagtaaagtacttacacctgttacatcttttttttttcaccatacattcatgatctaaatagagaaaacttatatctcttcattcttgttttatttggtcaggatcgtaaggtgtaactctatcctaatgccatctgtttatcctcatgacagaatcgtgaacctagaacataatcatagcacactgggttttatgtaaacattctctttttttttttttttttgagatggaatctcactctgtcacccagtctggtgtgcaatggtatgatctcgactcactgcaacttctgtctcccgggttcaagcgattcttctgcctcagcctcccaagtagctgggattacaggtgcctgccaccacgcccggctaatttttgtatttttagtagagatggggttttgccatgttgaccaggctggtctccgactcctgacatcaggtgatccacctgcctcggcatcccaaagtgctaggattacaggcgtgagccaccgcacctggccctcaaagaataggtttgatttaggtcaggcgtggtggctcacgcctgtagtcccagtattttgggaggccaaggtgggcggattatgagatcaggaggtcaagaccagcctgatcaatatggtgaaaccctgtctctactaaaaataaaaatattagctatgcatggtgctgcatagctccatgctactttggaggctgaggcaggagaatcgcgtgaacccaggaggtggaggttgcaatgagatcacgccgctgcactccagcctgggtgacagagcaagactccgtctcaaagaaaaaaaaaaaagaatggatttgatttatcccaaagacttgccaggtagagctccagagtagttgggtgctatcatctctctgcttatagtttgcctgaacttcttaatagaaagggaaatacattctttggtcctgaaactactgtcagtaccacttcttccctacctattcaggtaatttaagtgtcagaaacaaattgctcatctgcctgagttctgtgtgcagcctaaaaatgttctctcctctctcataggtatggtctctctggcagtgatgtcctggataatgtagcatatgctcgagcgttcaacacagaccaccagacccagctcctttatcaagcatcagccatgatggtagaatctaggtatgtgttcagtataagacaccaaatatgttcttaagagtccttccctgaatcttgtaatggctatttggccagattgatagtagtttgaattagaaatgaggaggtttaagtataattcctgtgttgacactcttgctttgtagtttaggtcaagtcactattaaaaatgaaaccataatctacttgaacttgctggaaatcttgttaaacggtgcctcagatgttagtactgtgcaaatattttaataaaacatctatatacaggccgggcgcggtggctcaagcctgtaatcccagcactttgggaggccaaggcgggtggatcacaaggtcaggagatcgagaacatcctggctaacacggtgaatccgtctctactaaaaaaatacaaaaaaattagctgggtgtggtggcgggcgcctgtagtcccagctactccggaggctgaagcaggagaatggagtgaacccgggaggcagagcttgcagtgagccaagaatgccccactgcactccagcctgggcgacagagctagactccatctcaaaaaaaaaaaaaaaaaaaaaaaaatctgtatacaggaaaaactatgaatatgagattttagggtggtaaggaagggaccagaatctgacacaggctagaaataggcttcagagaatccttgtttcctgtaggtatgcactgcttattgtagacagtgccaccgccctttacagaacagactactcgggtcgaggtgagctttcagccaggcagatgcacttggccaggtttctgcggatgcttctgcgactcgctgatgaggtaagttgtgggatagggacagagaatgcctactttcagtggctgtgaattccaggagccttgctaggaggctaagacatcagtgcctgagatcatcaagctcttaggaagaagagagacattagttattcgttattttgtgggggaaagtggtggcagcattaaggcttttggagtgtctatggccacaaaattgacatttatcctttccccatcagtttggtgtagcagtggtaatcactaatcaggtggtagctcaagtggatggagcagcgatgtttgctgctgatcccaaaaaacctattggaggaaatatcatcgcccatgcatcaacaaccaggtaaggtgttgatgggatcagttcttcttttcggaatgtcatattaactgtgaagacatgaagatataacattttcatttaagccctgttaaagctactgttgtatagacacttaggaactcttgctaatctaattaacatgctctcgttggtatagatgttttagttcataaaagaattaaaaacccacaagtgtggaagaatgaatatgagtaattgatatgcctctcccctgttatttaaaaaatgtttgggctgggcacagtggctcacactggtaatcccaacactttgggaggccaaggtgataggatggtttgaggccaggaattcgacactagtaagggcaacaaagtgaggcctctgtctctacaaaaaaaagtagctggtgtggtggcgtgtgcctgtagtcttagctacccaggagactgaggcaggaggatcagttgagcataggaattcgaggctgtattgagctatgatcacacatcactgcactccagcctggcaaaagagcaggacactgtcttgaaaaaattttttttctttttttttttttttttttgagatggagtctcgctgtgtcacccaggctggagtgcagtggcacgatctcggctcactgcaagctccgcctcccgggttcacaccattctcctgcctcagcctcccgaatagctgggactacaggcacccgccaccacacctggctaatttttttgtatttttagtagagatggggtttcacagtgttagccaggatggtctcgatctcctgacctcgtgatctgcccaactcagcctcccaaagtgctgggattacaggcgtgagccaccatgcccggcctaaatttttctttttttaatgtttgtttcaatatggacaatccactgagaggggccagggcaaaaatggattctgccaggttggaaatgcactaaggaaaacagtacagaaacattcccagggtccttctaggaagaatatatgtctaaaaaattttcagctctgttacaaagtcaggaacggaattgtttaattataataaattggtgctttggtctgtgtctttgggtcagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaa

SEQ ID NO: 1938 - DNA, 37030 bp, Homo sapiens; identical to SEQ ID NO: 1937

SEQ ID NO: 1939 - DNA, 37030 bp, Homo sapiens; identical to SEQ ID NO: 1937

SEQ ID NO: 1940 - DNA, 36979 bp, Homo sapiens
gaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgaggtgagtgtgtgaggcgcaggctgggccctccagagccgcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaagtgaggtttggttttcttaaaactttttttttgagatggagtctcgctcttccgcccaggctggagtgtagtggcgcgatctcggctcactgcaacctccgcctcccggattcaagcgattctcctacctcagcctcccgaggagctgggattacaggcccccaccaccacgccgccaggctgatttttgtatttttagtagagacggggtttcaccatgttggtcaggctggtctcgaacttctgacctcaggttatccacccgcctctgcctcccaaagtgctgggattacagccgtgagccacagcgcctggcccctgtttttttgtttgtttgtttgtttttaacttctaaagcgcaatgtaatatacatgtagaaaaattcacattcacaactgtatacaactccgtgaattattacaaaatatactggccgggcgtcgtgtctcacgtctgtagtcccagcactttgggaagtggaggcgggaggacgattgagcccaagagttcgagaacagcctggtcaagatagtgagacccgcatctctacaaataggaaaaattagctaggcatggtggcgtgcacctgtaggcccagctattcaggaggctgagaagggaggatctagcctgggaggtataagctgcagtgagctgtgatcaggccactgcactccaacctgggcgatagagcaagacaaaatgaatatacacctatgtaatcaccacttaatagaatggtcctcagaagccttcctgtgtagtatttaatattttcccctttttacagtggtaactgctatactggtttctaatgagatgaactaatgttgcttgtttttgaattttatataaaaatacatcaggagtgttgagtgtttcgttgtttcacatgcttgccaacacgatatttttcagcctttttgattttaactattctgctggttacacagtaatgtcttaatgtgattttaattttcctgattaataatgatgttggacatctgttcatatgtttttgcccattttgatatcttctgtgatgtgcttgttcaaatctcttgcctatttttctattatctttttcttactgatgtgaagttctttatatactggttatcagccctcagttatgtttgtgctaaatgttttctctactgtggtttgacttgtcactctcttagtggtgtcctttgatgaatagaagtgctgaatttatttttttattatttatttatttatttatttttccttttgagacagagtttggctcttgttgcccaggctggagtgcaatggcacaatcttggctcaccgcaacctccgcctcccgggttcaagcgattctcctgcctcagcctcccgagtagctgggattacaggcatgtgccaccacgcccagctaattttgtatttttctttaatagagacaggatttctccatgttggtcaggctggtcttgaactcctgaacttaggtgatctgcccgccttggcctcccaaagtgctgggattgcagacgtgagccacagtgcccagtagaagtgctgaatttaaatgtagttcagttttcagtcttttcctttttggctagtgcgttatgcatccagtttcaagaaatctttttctgtcccaaggttgtgaaaataataagtgttactttgtttttgacagacgattgtacatatttatgagatacaagatgatatttctttttttttttttttttttttgagacggagtctcactctgtcgcccaggctggagtgcagtggcgcgatcttggctcactgcaagctccgcctcctgggttcacgccattctcctgtctcagcctgccaccacgcccagctaattttttgtattttttagtagagacagggtttcaccatgttagccaggatggtctcgatctcctgacctggtgatccacccgccttggcctcccaaagtgctgggattacaggcgtgagccactccacctggcccaagatgatatttcaatacatatatacattgtataatgaatgatcaaatcagggtaatcagcatatccatcagttcacttaaacacttgtcatttctctttgtgatgagaacattcaaaatactcgcttctggctattttgaagtatacattacattagtgtttactgtagtcaccctactgtgaaatagaaccctagaacttattcctcctatctaactgaaactttgtgcctgttgaccaacctctctccttcctgccgccccctgcaacagctgcattctcctcagtctctggttaccactgttctatttgttccttgtatgagatgaacttttttttttttgtttttttttttgagacacagtctcactctgtcatgaggctggagtacagtggcacgatctcggctcactgcgatctctgtcttccgggttgaagccatttacctgcctcagcctcccgagtagctgggactacaggcgtgtgccaccacaccctgctaatatttgtatttttagtagggacggggtttcgcatgttggccgggatggtcttgatctcctgacctggtgatctgcccgcctcggcctcccaaagtgctgggatcacaggcatgagccaccgcgccccgccaagatcaacttttttagattctacatatgagtgagatcatgcagtatttgtctgcaaacacatttataatgtataatggggtatataaaaataagtaaaacttggcccctacactgaaggaatataaagcaggagaacagagaggcacaataagagaatggccttggcttttcctaaagtctttttgatacgactagctagatagaagatggggagagagatgcaccttatttctctagtgtttatactgataagcatttgtatttttcagtaatggcaatgcagatgcagcttgaagcaaatgcagatacttcagtggaagaagaaagctttggcccacaacccatttcacggttagaggtatgtggttagttgctaattttggaattatatactagattcttctacctagtggaaggtattacaacctttacataaaatataggtttactaccaaggtcaagacccaaattagacttttcagaagtgttgtcaataatcctgtggaaaggctgcagatcattgctaaatatgtctggcagggcctcttcctttgtcaacaattctcttcctactttatcatttttatttctgagagttggactgtcagaaactaaggcctaggatcccatggtggaatctctgtgctgtttttgtttgtttgtttgtttgtttttgatggagtttcgctcttgttgcccaggctggagtgcaatggcgtgatctcggctcaccgcaacctctgcgtcccaggttcaagcgattctcctgcctcagcctcccaagtagctggaattacaggcatgagccaccacacccagctaattttatatttttagtagagacagggtttctccatgttggtcaggctagtctcgaactcctgacctcaggtgatccaccctctttggcctcccaaagtgctgggattacaggcatgggccactgcgcccagcctgtgctgtttttttgtttgttttttaagaaatgggtcttaactgtgttgaccatgttgatcttgaactcctggcctcaagcagtccacctgccttggcgtcccaaactgctaggattacaggcatgagccaccatgcctggccaaagcatcctgtgctatttgcactaagtatgaaagtgctgttctgggaattatagcggcctggaccagttatgcaaggaagacagggaagcaccttctctccattaacctagatttgtgctgtcagctgtcattggcagagagaagggtgtggtggtgttatggtataagagacaagctccaattcaggattctgcacaagaacattaagcaccagagctgaggccttacactatttctgcccattgtatagagactgccctgtgagtgcagctgatttgggctaagtaggaggaaagcagagaaagacttgattcttctgtctctttttttcatatttcccatctctgactaatcttcaagactctagaagttaggagtgcaaaaggctaataaaaaaaaaagactctagaagttacttaaatggatttgtgataaacatttgaaagttcagagtcataacttctggtgccatgagcatccttatactcaaacatgcatattgcttaaatattaatagcagacatggcttatgttggcaaactaatctctcccctcttctaaattctcccaacccctgaatgcacccacattcacctactaactcatgttttcccagaagtcatggttttggtggctaatgaaaccaaagctgacttgaatataggaagaaagaggtgtctttgggtggtttgttttgagaagaggtataaaagtccctgacaaaaagtagttttcctcactgttaatgtcagttgttagagcagagctttctggtcattgttcaacaaaaagtattgacaggccaagatagtgctctttatattctgagcagccttatctatttaccctaccatagtgtaaaaatacagttttttatgtgtgcttgatgtggaaagtgttgagcaacactgtcttaaagtggtcttgtagggcccaaggtctcagagatcatttagggtcacaaaaaaaggttgggagttactttttaattccaattgctaataggagttctttttaatgtacatggcttagtgctagtttaaaattattgattttgataatgaaaaggttgttaatttgttattaagtacctcatatatagggctcatttttcagcttttgcatataataacagtaggctctctgtatctccggattctgtatcagcaaattcaacaaactacgtatcaaaaattcaatcaactacatatcaaaaaaaagtatacaggaggatgtacataggttatatgcaggtaatacgccattttatataagggacttgagcattgttggattttgttatctgctgggggtcctggaaccaacttcccatctccccccgcccccccaaggatttcaagggacagttgtattacaagtcttcaagcacctctgtgaagtatgtaggacacataacatctgtgttagattagagaactaaagcttaaatttatccatggttttcttcatttgcagcagtgtggcataaatgccaacgatgtgaagaaattggaagaagctggattccatactgtggaggctgttgcctatgcgccaaagaaggagctaataaatattaagggaattagtgaagccaaagctgataaaattctggtaagtactgcttacttaacctagggaggcattagtgggaatagtacaaaagggaatgtagtgaaagacttcttccttctatctcttattcttcggtcatctcattatcctttccaggggtgactgttacctgtttcttttcttcttttcttttcttttcttttttttttctttctttttttttttttttggagacgggttctcgctctgtcacacagggtggagtgcagtggtgccatctcagctcactgcaaccttcacctcccaagctcaagcgatcctctcacctcagcctcccaagtagctgggactacactacaggcacatgccaccatgccggggtagtctcgaactcctgagctcaggcgattcacctacctcagcctcccaaagtgctggattataggtgtgagctactgtgcctggcctatttatttttctagcttcatatagttctttaacatacatacttccccatggttacattttgttttatgaacctatttcttcagtgtttatatagttacacagttttattgcctttacccttgaagttttatgtagtataaagcagattttttttttttttttttttttttttgagacggagtctcgctctgttgccaggctggagtgcaatagcgtgatcttggtctactgcaccctccgcctctcaggttcaagtgattctcctgcctcagcctcccgagtagttgggactacaggtatgtgccaccacacccagctaatttttgtatttttattagagacagggtttcaccacgttggccaggatggtctcgatctcctgaccttgtgatctgcccacctcagcctcctaaagtgctgggattacaggtgtgagccaccgcgccccaccgcaaatatttatttataaaattgtattttcacgtatcgattactgttagcgttagataaatttattggattactcaaatgaatatttgctgaagtggttgcttaattggaaataagggttctgagtccctaacagtatttttgttaaaagattgtcatattgactaagccagtaggggtccctaaagtctttctgttttcgctttttgggtatcagtttttgtgaatgaacaaatgctgacaggatcttttctttttgccttgcgagatcttggtttcagaaatcaagtcacttctctgtttctatgaacacaacaatgcaaacctagaatacatgatttgagatgcaatatggtatagacttacgtgtctttacttttcaatattttatgttctttgtttctggccagtaaagattatgattgtattgtttgttttctgtttttttttgaggcagagtgtcgctgtgtcacccaggctggagcacaatggtgcaattttggctctgctcactgcaacctctgccttccgggttcaagtgattgtcgtgcctcagcctcccaagtagctgggattacaggctcccaccaccacacgtggctaatttttgtattttcagttgagacggggtttcaccatgttgcccaggctggtctcaaactcctggcctcaagcaatctgcccacctcagcctcccaaagtgctgaaattacaggcactagccactgtgcccaccttttttttttttttttaaagaaaaaaaagaaaagtctcactctgttgcccaggctggagtgcagtggcatgatcaaagctcactgcagcttcagcttcaaactcctgggctcaaggaattctcagcctgctgagtagctgggactataggcacatgccactagcctgaccatttctaccagttttgtctttgctaatacattctcctgtttttcaccaaaggaagtagtctatattccttgagctcccatggcttgttagtacttctcatattacccatcacatctacttgtactatagttattttgtatagtttatctttctgattaagttataagctctgtggaggcaggaatcagctcttctttttctccatatccttcagagtccctgggactatgtttcatacgaagtaagtgtctagtacatgtttgttgcactgaaatgacagtgagtatatgaattggccaggctggtctcaaaatcctggcctcaggtaatccgcccatctcagtatcccaaagtgctgggattacaggcgtgagccactgcacctggccgtgcaatgaatttttaaatgaaatattaagtatatagaaaagtttagagaataaactttcattgatttttcagctatttgttgattttttttcttcatgggaaatttaaacattatgaaagtttaatctttttactttctatgggtctatttagattttcttcttgagtgagttttggtagtttatctttctaagaatttgcttatttcatctaagttacctaacttgttgacatagagatgctcacagggtttccttatactactttttatttacataaagtcagtagtaatgtcccctctttcattcttgattttagtaatttgagtcttttctctttttttctcgggcaatgcagctaaaagtttgtcaattttgttgatattttcaaagaaccagcttttggtttcattgatttttctctattattctgccctctacttaatagtttctaccctaacctgtattatttccatctttctgcttgctttgttttgtttgcttttctttggaaggttaggttatgatttatcttttttatttttagaggcagagtcttgttctgtcacttacgttggagtgcagtggtgtgatcatagctcactgcagcctccaactcctggctcaaacaaaccttctgcctcagcctcccaggtaactaggaccacaggcacgccccaccatgccctgctatttattttattttattttatttttgagacggagtctccctctgtgcccaggctggagtgcagtggcgtgatctctgctcactgcaacctctgcctcttgggttcaagcgattctcctgcctcagcctcctgagtggctgggattacaggcacgtgccgccatgcccagctaatttttagtagagacagggtttcaccgtgttagccaggatggtcttgatctcctgacctcatgatctgcctgcctcagcctcccaaagtgctgggattacagtcgtgagccaccgcgccaggccttttttttttttttttctgatgcagtctcactctcttgcccaggctggagtgcggtggtgtgatctcggctcactgcaacctccgccgcccgggttcaagcagttctcctgtttcagcctcctgagtagttgggactacaggcgcacgccaccacgcccagctattttttgtatttttagtagaaatggggtttcaccatattgggcaggctggtcttgaactcctgacttcgtgatctgcccacctcaccctaccaaagtgctgggattcaggcatgagccaccatgcccagccatgccctactaatttttttttttttttttgagatggaatctcgctgtgtctctcaggctggagtgcagtggtgcaaattcagctcactgcaacctccgcctcccagattcaagtgattcttccacctcagcctcccgagtagctgggactacaggcgcgtgccaccacgcccggctaatttttgtatttttagtagagaggaagtttcaccatgttggtcaggctggtcttgaactcctgaccttgtgatctgcccacctcagcctcccaaagttctgagattacagaggtgagccaccacacccagccaccctgctaattttaaaacatttttagagccagggtgctgctttgttactcaggctggtctcaaactcctggcttccagcagtcctcccacctcagcctcccaaagtgctgggattacaggtgtgattcaccacacccagccttcttttctaatatagctgtttatagctatgaatttctctctaagcactgcttttcttggagcccatacgttttggtatatcttcgttttcattcattgcaaaaacattttctgatttcccttgtcatttcttctttgacttgttgcttatttaggagtgtgttgctttatttttgcatatttgtgaatgcacttacttttcaattttagaatcaacccatagtgctattacagaacacttatctgtaattacaaaatagaatgtgaatgttctcagccagacaatatgaaagaaaaggtacagctgatagaggtggggaagtagccatggagagagaaaagattgaagggcaaatgtcctcatttttacaaagtaggaagttaagggatacagtctgcggttgatggagcaggaaatgaaggtgtactgtattgtcatttttgtcataaattgggcaaaacacatatgtacggatctctaatagttttttgttttgttttgttttgttttttgagacagagtctcgctctgtcccccaggctggagtacagtggcgcgatctcggctcactgcaagctccgcctcccgggttcacgcctttctcctgcctcagcctaccaagtagctgggacttcaggcacccgccaccacgcccgactaattttttgtatttttttagtagagatggggtttcaccatgttagccaggatggtctcgatctcctgacgttgtgatccgcctgccttggccttccaaagtgctgggattacaggcgtgagccatcgcacccggccggatctataatagtttttaaaactatattaatatattaacttgaattggcaatttaaaaattgatcttcatggaatctctgaattagattatccttttttatgactttctaaagagaaatcatcctggtaattttatttgatattttctcttcccattgcacaccttgttttactaatatttcttttttctttatatatatttttttgccatcaagatcactgtggtaaggaatattattttgttgatttaatatttcttatttttcccaggctgaggcagctaaattagttccaatgggtttcaccactgcaactgaattccaccaaaggcggtcagagatcatacagattactactggctccaaagagcttgacaaactacttcaaggtgtagtaatcctttatcctgtgttgtgaactctagttaggaaagcttccaggttataaaacaaaactgaaatatttgtgtagcatttccttgttagataatgataaagagatagaggaaggccaggtgcagtggcttatgcctgtaatctcagcactttgggaggctgaggtgggcagatcacctgaggctgggagttcgagaccagcccagccaacatggagaaacctattaaaaatacaaaattagttgggcatggtggcacatgcctgtaatccctgtaggtgcacatgcctactcgggaggcagaggcaggagaatcacttgaacccggaagacggaggttgctgtgagccaagattgtgccactgcactccagcctgggtgacgagcaaaactctgtctcaaaaacaaagagagataaaggaagtatccacattgaagaggtaagactgctgcaaggtaggaccttatttataaaatactaaacttatctgcaaattaaataatttagtctccatttaatattgtgttaagagagtaagctccttttgcttaaggaggtaactgtaattataacctactctaccacagggttgaaaacctgatgactggttaaaacattccatgtttgaatactactcattgtgtacacactaatcttcaggacttcagggaaaactataaagcttttgaccttattatttatttttcgagacagggtctcactctgtcacccaggctggagtgcagtggcatggtctcagctcactgcaacctctgcttcctgggctcaagtgatcttctagcctcagtctccccaagctaggactatgatcatttaccacctggctaattttttttttttttttttttttttttgagtcggggcatcactcattatgttgcccaggctggtctcaaaatcctgagctcaagccatcctcctgcctcagcctcccaaagtgctgggattataggcttgagccaccttgcctggcccaatgtcagttttctttcccttttttttgagacagagtctcactctgttacccaggctggagtgcagtggcataatctcagctcactgcaacctccgcctcctgggttcaagtgattctcctgcctcagcctcccaagtagctgggactacaggcaagtgccaccatgcccagctaatttttgtatttttagtagagatgaggtttcaccacgttggctaggttggtctcgaactcctgacctcagatgatctacccgcctcagcctcccaaagtgctgggcttacaggcgtgagccatcatgcctggcccccaatgtcagttttctaatatcagtgctatactatcattatgcaagaggttaacactgcagaaggctaggtgcatagaaatttcgtatgtttttttttgttgttgttggtttgtttgtttgttttttaaagacagagtcttgctctgttgcccaggctagaatgcagtggcacaatctcggctcattgcaaccactgactcccaggtttgagcagttctcctgcctcagtctcctgagtagctgcaatgacaggcacccgccaccgtgcctggctaatttttgtatttttagtagagacgggatttcaccgtcttggccaggctggtctcaaagtcctgacctcctgatccatccacctcggcctcccaaagtgctgggattacaggcatgagccactgtgcccagcttttttttttttttttttttttgagatggggtcttgctatgtcaccccggctggagtgcagtggcatgatcttggctcactgccacttccgcccccaggttcaagctattcttctgcctccgcctcccgagtagctgggactacaggcatgcaccaccatgcccagctaatttttgtatttttagtagagacagggtttcaccatattgtgcccagcttttttttttttttttttgaggagtctcactttgtcacccaggctggagtgcagtggcgtgatctcggcttgctgcagcctccgcctcccaggttcaagtgattctcctgcttcagcctgctagtagctgggattacaggtgcccatcaccagttccagctaagttttgtatttttagtagacatgaggtttcaccatgttggccaggctggtctcgagctcctgacctcaggtgatcagcccgcctcggccccctaaagtgctgggattacaggtgtgagccaccgcacctggccttatttgcagctatctataaatctaattatttcaaaatacttttggtttatttgtttgtttgtttgtttgttttgaaacagggtctcactgtgtcacccaggctagagtgcactggcacgattttggctcactgcaacttctgcctcccaggctcaagtgatcctctcaccttagctcctgagtagctggtactacaggcatccgccaccatgcccggctaatttttgtagagacagggcttcaccatgttgcccaggctggtctcgaactcctgaactcaagcaatccacccacctaagcttcctaaagtgctgggattacaggcatgagccaccacggctagcctcaaaatacatttgtgaaaaattatcgcttgttggaaattgaatttttaacttacataaacatctttctgatgagctccaagaacatttctatgactacagtttctacatgtttgtattatgctaagagttatttcttatcgcttttttaggtggaattgagactggatctatcacagaaatgtttggagaattccgaactgggaagacccagatctgtcatacgctagctgtcacctgccaggtgagctgttggggctatagctaatcaaataagcaagcattacttcattcctgctatttgcaagcatctgttaggatggccataaaaggtactttctctgtcctcaagaatcttatagctgttaatagttagaagatagactcctacttcaaaatccttccatgtcatagaaacttccaaatcattgatctcctatcagatacgttaatttcaaatacttttgctaccaggccttttcctggctttacttgctactttttttttttttttttttttttgaggcagaatctcgctgtgtcgcccaggctgaagtacagtggtgtgatctcagctcactgcaacctcctctctggttcaagtgattctccttcatcaacctcccgagtacctgggattacaggcgcccaccagcatgcccggctaatttttgtgtttttagtagagagggggtttcaccatgttggccaggctcctcttgaactcctgatctcaagtgatccacccaccttggcctcccaagtgctggaattataggcgtaagccactgcgcccagccctccatcttcttcattagtctagattttatgattcatcattaaagtaattctcttgcagatagcctcagtttacatacccacttgaagagatgccaaccttagatgaaactcatctatcttctcagtgtctgtacccaaatagctgattatactggagaaaaatcgtatcatacagctgactgacttcactttaaattcaagatgacaggccaggcacggtggctcacgcctgtaatcccagtactttgggaggccgaggcgggtggatcacttgagatcaagagtttggctgggcgcggtgactcacgcctgtaatcccagcactttgggaggccgaggtgggcggatcacaaggtcaggagattgagaccatcctggctaacacagtgaaaccccatctctactaaaaatacaaaaaattagttgggcgtggtggcgggtgcctgtagtcccagctacttgggaggctgaggcaggagaatggcgtgaacccgggaggcacagcttgcagtgagccgagattgcgccactgcactccagcctgggcgacagagcgagactctgtctcaaaaaaaaaaaaaaaaaaaaaaaaaaaaagaagaagaaaaaaaaaagatcaggagttcaagaccagcctggccaacatggtgaaaccctgtctctactaaaaatacaaaaattagctgggcgtgttggcacgtgcctgtaatcccagttacttgggagactgaggcaggagaatcgcttgaacccggggggcagaggttgcagggagctgagatcgcaccattgcattccagcctggtcaaagaagcgagactctgtctcaaaaaaaaaaaaaaaaaaaaaaagaatgaaaaaaggaaaaaaattcaagatgacaaaactttagattaacattcaaaacttcttggcagtctactttctccatttaggtgtactttcccactgagttagacaggcatctcatatctcatacttcgtcttctgttatcagaactttatgctcctcttcaactctcattcttagccaaaaacctaacctgctctttgcatcaaatctacatttgtgcccatcttttcttatctcaggttacaattgagaaagtgtcccttttcttctcaaaggcccattctatcaatatgatttggttaccatctcctgccaccttctcaaggactctactccttccattttctcttgtacctctctatgagattatcctcatcagtatacaaatatgtctagtgtctcctccattaggaaaaaaccttccctggaccccttcagtttctttttcctttacttatgctcctattggtgggaagatttggaaatagacacagtaggttaaataattgcccaatacattgtatttaagtagcaaatactggactcaaaccagacttcagagatgatgttcttaaaacttcataagaggccagcatggtgtttcatgcctgtaatcccagtactttgggaagccaaagtgggaggattgcttgagaccaggaatttgagaccagcctgggcaacatagtgagaccctgtttctgagatgccatttctaaaaacaaacaaacaaaaacagacaattaaaaatattagcccagcatgatgatgtgtacctgtggtcctagctactcaggaggctgaggtggtagaatctcttgagcccaagaggtcgaggctccagtgactgggatcgtgccactgcatgttttctgctgtattgctagtgcctaaggcagtgtttggctctcagtaaacaataaatgcttgaatgagtggagataatagatgtccaaaaacatgcctgatatataaaatgaatgtcacagaggaaatgggttagctgtttaaggaatagaaaggggtaatttcaccctagagtgatcatggaatactttatggagaaaagattttggaccagacttctgaagaatgctaaatttgggaaggaaggaaattaaaagcatttaactgtatagaatgggatgaacagaggatgggaaggcataagttagaaggaaaagacaataaataagcaaggtcatttaactggtttagagtttgtgtagaaaagttgtaggagatgacccttaaaaagatacatcaaactgggcatgatagctcacacctgtaatcccagcactttgggaggccacggtgggtggatcgcttgagctcaggagtttgagaccagcctgggcaacatggcaagaccctatctctacaaataatataaaaattagccagacgtgggctgtgcctgtagtggcagctacttgggaggtggaggcgggagaatcgcttgagcccaggaggccaaggttgccatgagccaagattgtaccactgctctccagcctgggcaacagagcaagattttgtctccatctcaaaaaaaaaaaaaaaattaagatcctatttcagaaggttaagaagtttaaacttgattttatgaagagtaagcattagctggtcaggaaactaagatagtgacaataaagagaagtagggaaaagatgttgtaaagggcagcgcttgatgactgacaataaaaaatacacctcagcccaacaatgtattacagtaacttagtaaacctaaaaagtgtttgagaggggaagacagttttgttggaaacatgagtacaggtttagagatgacaggtttgaggtgacaaaccccgagtgaaaatttctagctgtattgagagatgtggaactaagtcacacagagaagtaaaaatggaatctggaaacgaaagatccatgagaaaggaagggagtaggatatagaagagaaagctaacaaactttcatcttttctgcaacttcaggcagtgtaatggggagccgtttttccttgtctaagtgagtcttaatgttctctggctttaaggatgtgctgcataagtggccagtccacaaagtatccttgaacctggcccatgcccatggaccaactcttctgttataatcttttgaagctttattataattttagttattttgaaaaacatggcattattttaatctagatagattatacccacttctgccatgggcacaacttactgttggagatcaaaacaactgaaacaaaatctgccttatatcagtgttacagaagaggcttcctagtgtttttctatcctcgggactcaactctgttgagtttttttttcttttcttttctttttttttttttttttttgagaaagagtcttgctctgttgcccaggctgtagtgcagtggtgtgatcttggcttgctgcaacctctgcctcccaggttcaagccattctcctgcctcagcctcccgaatagctgggattacaggcatgacggccaccacgtccagctaatttttgtatttttagtagagacgaggtttcaccatgttggccaggctggtctcaaactcctgacctcaagttaatctgcccgccttggcctcccaaagtgctgggattacaggagtgagccaccgtgcctggcccaagtttatttaaatttaacatcaagtaacctagcttgatagcctcccatttttcttattttcctttttttttttttttttatttgagacggagtctctgtcgcctaggcaggagtgcagtggcgcaatcttggctcactgcaacctccatctcctgggttcaagcagttctccagcctcagcctcccaaactgggattacaggtgcctgccacccaacacagctaattttttgtatttttagtagagacaaggtcttgctgtgttggccaggctggtcttgaactcctgacctcaggtgatccacccgcctcagcctcccaaagtgctgggattacaggtgtgagccaccatgcccggctttttgttgtcattttaattgtttattgctccactgatattttctttgcagaccaaaatgttacaatttttttttttttttttgaggcggagtctcattctgtcgcctgggctggagtgcagtggtgccatctctgctcactgcaagctccgcctcctgggttcacgccattttcctgcctcagcctcccgagtagctgggactacaggcgcccgccaccacgcctggctaattttttgtatttttagtagagacaggttttcaccgtattagccaggatggtctcgatctcctgaccttgtgatccgcccaccttggtctctcaaaatgctgggattacaggtgtgagccaccgtgcctggctggctgccatatgtcttatgagacagccaagctagcatgtcagtatcgagtagacctaatccattgttaactctcctcagaaataaattcttttttttttttttttttgagattgggtctcactatgttgcaccggctgttcttgaactcctgagcgcaagcaatcctccaacctcagcctcccacatagctgggattacaggtgaatgcctctgcacccagatcctcataatcattaggaagaaagagctgagggggaggggtggaggaggatgcttaggagaccttttatgataataagggaggaaacattgagaagaggaagagtaagttatagaagctatagctattgcgtgagctccattagaaatttgatagctaaagggaattagggctgtttaaaatgtcactcttacatccgtcatttgacatgatatgtgacctttttaaatagaaatgttttcccatgttttgacagggacttatgtagaataagtatttagactacagtacataatatctatagttgccatggcaactcagcatagcatgctgacactccaaagttgtacaaatagaatcctaatctgagaatgtttaagtagtcagataatgtctgtcaacaataaactaaagcaaaattctcaagtaaatatagcctgttaaaataacatttacagatggctgaacaactatatagatcgttgactttttttaaagaaaaagaatgctaattaattaataatagaaaagattacatttcatcagcctaagagctggaaccagggatatagagaggatgttagactattacttaaatctaaatattatctactctcatttgttttctcaatttaatgaagtaaaaccccattatatgttaggtctctctctaatagaaaagtcataaagttgagagctacagttaggttacaaaatgaattagcccatgcttgttcaaagtactgcagtagttttaaaattctgggccgggtatggtggctcatgcttgtaattccagcactttgggaggctgaggccggaggattgcttgaacccaggagttccagacaagactggggaatatggcgagatcccatttcaattaaaaaataaaaacagttctgagaagacaatttaacataagtaccagttttaaaagcacatgcccatgcgggcatggtggctcacgcctgtaatcccagcactttgggaggctgaggtggatggatcacaaggtcaggagttcaagaacagcctggccaagatggtgcaaccctgtctctactaaaaatacaaaaattagccaggcgtgggggtgggcgcctgtaatcccagctacttgggaggctgaggcagagaattgcttgaacctgggaagtggaggttgcagtgagctgagatcgtgccactgcactccagcctgggcaacagagtaagattctgtctcaaaaaaaaaccaaaaaccaaaaaaccacaaaacaaaaaaatcacataccctttgacagaaaatttgtcttacagaacatttcacatatatgcaaagataaatgtacaaataatttataccaaagcataattaaaatggtaaaagttagaaacatactgcatcactataaaatgagaagtgttaaattatgctcctaagcagttattaagaagagctaacctgatggtatcccaatccagtaacagaagatggctatgatggcactgggagggcaaggtagaaagggccaaataagctggagaacagagcatgcaatccatccccatgatcttaccctgggagcttgtccactatcctgttgtcagtctacctacctattcccaatcatctgtggcctttcctttgccaaggaagtctattcaattggaaaagaatcccctgtcatgttagcacttaatattacctggaggtaggagaaaggagaacttcgttcatcttatttcctggggacttagtccccagagtgttaatatttcctcctctccaagaaactgaggcagattctgctctctgtcctcttggccactggttccaagtctttctttaggcatgaccctcttttgttgtatatgtgtcctttgctccttccatggattcccatgatgtgagagattttatctgccaaatagtaacgtaatttttcccttccaaattaacaaagccttccgtaactgtatacactaaagtcagtgccctaaaggttgggaaaatcatgtcttcagagtgtaccgtgctaaacgctttacatgaattattttatttagtttttaaaacaatcccataaggtcggttttatttacattttacagaaaaggaaacaatattctcagtcacatagtaagtggaagaaccacttatataaaagaagtatatgaaaatgcatagaaaataatctgggaaattatttctgggagatggagagtggtgaagagctttcagttttttctccgccacttcctctttttttttttagacaaagtctcactctgtcacccaaactggagtgcagtggcatgatatcgctcactgcaccctccgcctcccaggttcaagtgattcttgtgccccagcctcccgagtagctgggattacaggtgtgcaccaccacgccccactaatttttgtatttttagtagagacagggtttcaccattttggccaggctggtctcgaactcctgacctcaggtgatccactcgctgggattacaggtgtgagcccccatgcctggcctctctacttctttttttttttttttttttttgagatggaatctcgctctgtcacccaggctggagtgtagtggcacgatctcggctcactgcaagctctgcctcccaggttcacgccattctcctgcctcagcctcccaagtagttgggactacaggtggccgccaccacgcccggctaattttttgtatttttagtagagacaaggttttaccatgttagccaggatggtctcggtctcctgacctcaggtgatccacctgcttcggcctcccaaagtgctgggattacaggcgttagccactgcgcctggcctccggccctctacttttatattgtttagatttttaatataagcatatagttgttttgtaatttcaaaaaaaaattctcaaagataagaaagaaaatttgggctgggtgcagtggctcacgcctcccagcactttgggaggccaaggtgggtgaatcaccttaggtcaggagttaaagaccagcctgaccaacgtggagaaaccccatttttactaaaaaatgcaaaattagccgggcgtggtggtgcatgcctgaaatcccagctacttgggaggctgagggaggagaatcccttgaacccgggaggcagaggttgtggtgaggcaagatcatgccattgcactccagcctgggcaacaagagcgaaactccgtctcagaaaaaaaagaaagaaaaaatttggttctcctaggcctttaacataaaatgttctaaaggattttcctcataatttaaatgggaattatgactccaaagtagatttctagagtagaaattaccctttagcatcattcacttaaactttgtagaaaaattcaaaggtatctggtatggaatgggtagtctaaagcagagatttccttgagtggctcataagacagttttcatggcatttcatttacttctcttttctttcctttttgttttctctttaaaattctttctacttatttttctgttttctccaattgttcattttaaacatcttgtttatactattggagtaaatatgtttttttcttctttcttgctcacactcgaaatttgctatagacactccgagggcattgactagtccctttagtacccctaaagaatgaactgctcaataaagtgaagtataagtttgatatagacatgctaaaattaactgggctttggatcatggcccattattgattaaagctaaggtaaatggtcttccaagtttctgtacttttgaattgatcagtcttgtgttggtatgcagttctagaattttattactggccaggtgtggtggctcacgcctgtaatcccagcactttaagaggccgaggcgggcagatcacttgagtccaggagttcaagaccagcctgggcaatgtggcaaaaccctatctataaaaaaatttaatcgggtgtggtggtgcacacctatggtctcagctatttgggaggtgagatgggaggatctccagagcccggaaggcagaggttgcagtgagccaagattgcaccactgcactccagcctgggcggcggagtgagaccctgtctccaaaacaaaaaaaggccaggtgcagtggctcgtgcctataatcccaacactttgggaggccaaggcaggcagatcacctgaggtcaggagttcaagaccagcctagccaacttggtgaaaccctgtttctactaaaaatacaaaaattagctgggcgtggtggcatggacctttaatctcaacaactcaggaggctgaggcaggagagttgcttgaacccaggaggtggaggttgcagtgaaccgagataacgccactgcactccagcctgggcaacagtgagactatcgcaagaaaaaaaaaaaaaagaagaaaagaattttattacctactttgggctatatttctaagcagtccagttctgacaggactagctgtatgtactgagacacaatcagctttacatatttttctagctgtatttctattaatatcagaagggaatgcctccttcctaccactgtcatttttaaatgtttttttccctttgccttggaggaattataaagatgtcatgaggagcttggtcagctgtatcagaaatacaatgttcatttctactgttgtttttgttctctatagcttcccattgaccggggtggaggtgaaggaaaggccatgtacattgacactgagggtacctttaggccagaacggctgctggcagtggctgagaggtaggttactggtttagataagagagactatggctacacttatcaatgtagtgattgccagggttagtttggccgaagaatgtctcttctataaccccacgtcccaaagttgtatgtgtggttcaaaagaatgacttccttagtagaaaaaggcattcttttttttttttttcttcagatggagtctcgctcttgtcacccaggctagagtgcggtggcgtgatctcaggtcactgcaacctctgcctcccgggttcaagcaactctcccacctcagccttcctagtagctgggattacaggcgcacaccaccacacccagctaattttttgtatttttagtagagatggggtttcaccatattggccaggctggtctcagactcctgacctcaggtgatccacctgccttgacttcccaaagtgctgggattacaggtgtgagccaccgcacccggccagaaaaaggcattctttagagttgctgtcagactggatttaaaaaaaaaaaatccaactatatgttttcttccagagaaaccctttagaaagtaaaagaatggagaaagatattgcatgcaaatagtaaccataagagacactgcgtggctatactaatatcagacaaagtacactttaaggcagacacattggctgggcgctgtggctcacgcctgtaatcccaacactttgggaggctgaagcgggtggatcacgaggtcaggagatcgaaaccatcctggctaacacagtgaaacctcgtctctattaaaaatacaaaaagttagccgggtgtgttggtgggtgcctgtagtcccagctactcgggaggctgaggcaggagaatggcctgaacccgggaggcggagcttgcagtgagccgagatcgcgccactgcactccagcctgggcgacagagcaagaatccgtctcaaaaaaaaaagacaaacacattatatacaaagaggaacattttataattaaaaggtcagtttgtcaggaagatataacagttgtaaagatacacacacgcctaacaacaaaaccccaaaataacatgaaacaaaaactgaattaaaggggaaaatagacaactcatcaataatagtaagggaccagtttttcattttcattaatggatacaggcttcaatatttcactctcaataatgaatataacatgtatcagaggccctgctaaagggcatctgtgaaaaacctacaggtagcatcatactaaatggtgctctgttacccaggctggaatgcagtggtgctatttcggctcactgcaacttccacctcttgggttcaagtgactctcctgcctcagccaaaaattagcctggctaatttttgtatttttagaagagacagggtttctccatgttggccaggctggtctcaaacctgacctcaagtgatctgcctgccttggcctcccaaaagtgctgggattacaggtgtgagccactgcacccggccttaatggtgaaattctgaatgcttttccccctaaagtcagtaacaaggcaaggatgcccactttcactatttacattcagcaatgtaccaaagattatagacagtgtagtcagacaagcagatgaaataaacggcatccagattggaatggaagaaggaaaactatttgctaatgacatggtgccatatgtagaaaatcctaaggaatccatccacaagaaaaactagaactaaataactgttcagcaaagttgcagaatacaatatcaatatacgaaaatccattgtatttgtatatactagacaataacaattcaaaagtaaaacttgaaaaaaaaacttcattcacagtagcaagaaaaagaataaaatacttaggaataaatttaacaaaagaaatgtaagatttgtacagcaaaaactctgaaacattactgagaaaaattgaagatttacataaagagaagcattccacatcatggatgggaaaactcaagattactaaaatggcattcttggccaggtactgtggtgcacacctgtaatcccaacactttgggaggccaaggtgggcggatcacctgaggtcaggagttcgagaccagtctggccagcatggcaaaaccctgtctctactaaaaatacaaaaattagccaggcatggtggcacactgcctgtagtctgagctacttgggagggtaaggaaggagaatcacttgaaccagggaggcagaagttgcagtgacctgagatcgcgccactgcactccagcctgggtgacaaagcgagactctatctcaagaaaaggcagttctcctcagattttatctatagattcaacccaatccttatcaaaattccagcaagctttttttgcagaaatttacaaagtaatcataatatttatggaacataacgtggaaatgcaaaggacccagaatagccgaaatgtctggaaaaaaaagaaaatttgaggtcttagactttttggtttaaattcttattataaagctacaataaccaagacaatatggtgatggcatatggataaatatggagagttcggaaatgaaacctttatggtcacttcatttttgacaaaggtaacaggcaatttttttaaaatttaaaattttttacaaatacacgtggtctcgctgtcttgccctggctggtctcgaactcctggcctcaggtgatcatccctactcagcctcccaaagtgttaggattacagatgtgagccactaaacctggctgacaaggcaatttaatgagggaaaaaatggtcttttcaataaacagtgctgatgtagatgaatttccaaatgcaaaataactttagacccttactatataccacacataaaaattaaaatagataacagtgtggtcattcctcaaaaaattaaacacagaatgaccatgtgatccagcagttccatttccagctatataaagaattgaaaacaggaactcagatacttggacagcgatgttcatagcagcattactcacaatagctttggaaataacccaatgtccattgacaaatgaatagataaaatgtacatacacacaatgaaatatcattttagccttaaaaggaagaaaacacattttttttcttagacctagtcctgcagataaaaaggtaggaaattctgacacatgctattaacatccactaaccttcagggcattatgctaagtgaaataatttagtcacaaaaggacaaaaactgaggccaggcgtggtggcttatgcctgtaatcccagcactttgggaggccgaggcaggtggatcaccttaggtcaggagtttgagaccagcctggccaacatggtgaatccccgtcactactaaaaatacaaaaaattagccaggtgtggtagcacagacctgtaatcccagctactctggcggctgaggcaggagaatcgcttgaacctgggaggtggaggttgcagtgtgccgagatcatgccattgcactatagcctgggcaacaagagcgaaactctggctcggggaaaaaaaaaaaaaaaaggacaaaaactgtatgattccactaacatgtggtacttcaaaatcaaagagacagaaagtagaatggtggttttctgggggtagggagactggggagttgttgtttaatggtacagtttcagtttgggatgatgaaaaagctctggagatgaatagtggtgatggttgcacagcagcatgaatgtccttaatgtgcctgaactgtatactttaaaatagttaaaatgctcaatttaatgttatatgtgtacgttttactatactgtttttagaagggtgatagtcctaaataagagcctaactataatttttcagagagaacatgggagaaaatcttagtgaccttggggtaggcaaagatttattagctacaacaccaaacacacagtccatgaaagaataaattgataatagagttagttttcacttcatcaaaattaaaaacttctgtgcttcaaaggacactatgaagcaagtgaaaagataacccaaagaatgtgagaaaatatttgcaaattacgtatctgataaatgtctagtatctagaatatataaagaactattataacccaacaataaaaagataacccagttgtttaaatgggcaaaggatttgaatagacatctctccaaagaggatatacaaatggttgatgagcacataaaaagatgctcaacatcattagtcatcaggaaaatgcaaattgaaaccatggtgagctaccacttcacacccactatgaaggctataataaaaaagatggtaacaaatactgggaggatgtagagaaactggaaccctcatatactgctggtgaaaatatacaacggtggtctctttgcaaaataggtggcttcttaaaaagttaaatataaatttaccatatgatgcagcaatttcactctagttatataccccaagagaaataaaaacatgtctatacaaagacttgtatgataatgtttatagtatcattataatagcccaaaatgttcatcagctggtaaatgaataaacaaaatttgttttctccatacaatgggatactcttcagcaataaaaaagaacttaagtactgatacgtgttaacaacatggatgaggtttcaaatatgctaaatgatagaagttaaacacaaaagaccacacaatgtatgattccatttatatgaaatttccagtaggggataatctaagggatagaagaattgtggttagtggcgataggaatgaggaataactgtgaatgaagttgagagattttttaggggtgatgaaaatgctctaaaattggattgtgttcatggttatacaactctgcaaattcactaaagctctcaatgaattttatacttacagcaggtcatttttgaggtatgttaattatacctgagtaaagctcgtgaagagtttgtaagtttctatatcaaataaagtttttaaatacatcctcaaaactgtttcacttcttttcctttgtctagggtcaaatgtggtaatttagtccctgccacacattttatggaaacccagtgataaaacaatttaattgtctgctgagatgtcagactcaagttggaacctgcctaaatgaggagaatattctctctcgttttataatcgaattatctttcccagcttataatttgagaactgcaacctattgaatgtataccactgaagcataaaattaggttggaatggtaattgcagctttttgtctctgcctacaaaattcctatgaaggaaaaggaattactcttttgcagtctgatcttagttttctgaggatgtatatacttaattgtgtcttccctctcaaaattgttttggcaatcatgtacagcattcatacttttaagtatactgttttagtagtttaaggattagcttttggacagagtcactaaaacattctcttgtaacataaataagtattcagataggatagatgacctagtagaatataggctatgaggacaagaactttgatttggtcacctattggatgcccaagcagtagagcaatgcattcaggatttgttaatgaatattttgctgacaaaaaattttttgttgtttgtttttttagagacgggtctcactctgcccccactagaatgcaatggtgcaatcatagctcactgcagcttctaactccagggctcaagcagtcccccctcctcagtgtagctgggattacaggcacacaccaccaagcccagctaatttttttatttctttttttttttttttttttttttgagacagagtctcgctctgtcgcccaggctggagtgctgtggtgcgatctcggctcacgcaagctccacctcccaggttcacgccattctcctgcctcaacctcccaagtagctgggactacaggcttccgccaccacacccggctaatttttttgtattttttaattttaattttttttaattttttttaatttttttttttttttttttttgagacagagtctcgctctgtcgcccaggccggactgcggactgcagtggcgcaatctcggctcactgcaagctccgcttcccgggtccacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgtgcctggcctatttcttatttttgtagagatgaggtcttgctgtgttgcccaggctggtctcaaactcttggcctagagtgattctccctcctcggcctcccaaagtgctgagattacaggcaggcataagtgactgtgcctcgctgaaaaatatgtttacatagaaatttcattaatttgttttaatcaggtctctttatcaagaaaaaaattttataattgaattatatttctgagaatgtcacaaggcctccttaagctaataaaaatagccctctttcattcacaacaaaagagcccttactgattaatttttgccgtgccctgttgaagaatattagcccacatgcatgttactgtagctctggggttcccagaacatggtccccagaacagcagcattatcattacttgagaacttgttagaaatgcaaattgtctgatgggacttcagatctactgaatcagaaacaatcagatactcgggctagcaacctgttttaacaagctctccagggccagacacggtggctcacgcctgtaatcccaacactttgggaggccaagggagtggatcacctaaggtcaggagtttgagaccagcgtggcaacatggtgaaaccctgctctactaaaaatacaaaaactagctgggcatgttagcgggcacctgtaatcccagctactcgggaggctgaggcaggagaatcacttgaacccaggaggcggaggttgcagtgagccaggatcgtgccactgtactccagactgggcgacagagtgagactccatctcaaaaaaacaaaacaacaaaaaaaaatgcaagctctccaggtaatctgatgcttgctaaagtttgaaaaccatgaccacaattgctagcctttcttgaaagtctgaagtactgtgaaagaatgacagaactcctttgagatgagcttagtttttcaaacttatatgttaagaataacctgaggtatttgttaaatatacagattaccaggctcttccctgataattgtaattcattgagtctaggttaggcccaggaattttttttttttttttttgagacggagtttcactcttgtctcccaggctgccaggctggagtacagtggcgtgatattggctcactgcaacctccgcctctcgggttcaagcgattctcctgcctcagcctcccaagtacctgggattacatgcgtgcaccaccacacccatctaatttttgtattttttaagtagagatgggttttcgccttgttggcaaggctagtctcgaactcctgacctcaagtgatccgcctgccttggcctcccaaggtgctgagattacaggcatgagtcaccacagcctgcccaggaatttgttttctaacgggtgttccaggttattatctttaaggaagttcaagaaacactatgaaagaggatgctatggccgggcgcggtggctcatgcctgtaatcccagcactttgggaggccgaggcgggtggatcacaaggtcaggagatcgagaccatcctggctaacatggtgaaaccccgtctctactaaaaataaaaaaattagccaggcgtggtagcgggtgcctgtagtcccagctactcgggaggctgaggcaggagaatggcgtgaacctgggaggcggaacttgcaatgagccgagatcgtgccactgcactccagcctgggcgacagagtgagactccgtctcaaaaaaaaaaaaaaaagaggatggtatttccagccaacttgtcccaagctgtgggaattccatgtcctgcttctggagcctaagcacagaggttcccatagttttttttgtgagtgccgctgagagaaaagctaggataactctttattctggtaaaccttctctgtttttatagcaaatagataatctccctttcttttttaatttttaatttttttttaattttataaatagagatggggttttgccatgttgcccaggctggtctcaaactcctgagctcaagcaatcctccccactcagcctcccagagtgctgggattacaagcatgagccaccgtgcccagccttttctccctttctgatagtagattatatcagtgtatttttttgttcgtttgtttgtttgtttttgagacagagtcttgctctgtcacccaggatggagtgcagtggtgcgatctcggctcactgcaacctctgcctcccggtttcaagcgattctcctgcctcagcctcccaagtagctgagaagcagggattacaggcgcctgcaaccaacccggctacattttgtatttttagtagagatggtgtttcaccatgtagtctaggctggtctcaaactcctgatctcaagtgatctgcccacatcagcctcccaaattgctgggattacaggtgtgagccactgcgcccagccatatcagtgtttcttgaggcagaactagaagacttgtgcagtaaagtacttacacctgttacatcttttttttttcaccatacattcatgatctaaatagagaaaacttatatctcttcattcttgttttatttggtcaggatcgtaaggtgtaactctatcctaatgccatctgtttatcctcatgacagaatcgtgaacctagaacataatcatagcacactgggttttatgtaaacattctctttttttttttttttttgagatggaatctcactctgtcacccagtctggtgtgcaatggtatgatctcgactcactgcaacttctgtctcccgggttcaagcgattcttctgcctcagcctcccaagtagctgggattacaggtgcctgccaccacgcccggctaatttttgtatttttagtagagatggggttttgccatgttgaccaggctggtctccgactcctgacatcaggtgatccacctgcctcggcatcccaaagtgctaggattacaggcgtgagccaccgcacctggccctcaaagaataggtttgatttaggtcaggcgtggtggctcacgcctgtagtcccagtattttgggaggccaaggtgggcggattatgagatcaggaggtcaagaccagcctgatcaatatggtgaaaccctgtctctactaaaaataaaaatattagctatgcatggtgctgcatagctccatgctactttggaggctgaggcaggagaatcgcgtgaacccaggaggtggaggttgcaatgagatcacgccgctgcactccagcctgggtgacagagcaagactccgtctcaaagaaaaaaaaaaaagaatggatttgatttatcccaaagacttgccaggtagagctccagagtagttgggtgctatcatctctctgcttatagtttgcctgaacttcttaatagaaagggaaatacattctttggtcctgaaactactgtcagtaccacttcttccctacctattcaggtaatttaagtgtcagaaacaaattgctcatctgcctgagttctgtgtgcagcctaaaaatgttctctcctctctcataggtatggtctctctggcagtgatgtcctggataatgtagcatatgctcgagcgttcaacacagaccaccagacccagctcctttatcaagcatcagccatgatggtagaatctaggtatgtgttcagtataagacaccaaatatgttcttaagagtccttccctgaatcttgtaatggctatttggccagattgatagtagtttgaattagaaatgaggaggtttaagtataattcctgtgttgacactcttgctttgtagtttaggtcaagtcactattaaaaatgaaaccataatctacttgaacttgctggaaatcttgttaaacggtgcctcagatgttagtactgtgcaaatattttaataaaacatctatatacaggccgggcgcggtggctcaagcctgtaatcccagcactttgggaggccaaggcgggtggatcacaaggtcaggagatcgagaacatcctggctaacacggtgaatccgtctctactaaaaaaatacaaaaaaattagctgggtgtggtggcgggcgcctgtagtcccagctactccggaggctgaagcaggagaatggagtgaacccgggaggcagagcttgcagtgagccaagaatgccccactgcactccagcctgggcgacagagctagactccatctcaaaaaaaaaaaaaaaaaaaaaaaaatctgtatacaggaaaaactatgaatatgagattttagggtggtaaggaagggaccagaatctgacacaggctagaaataggcttcagagaatccttgtttcctgtaggtatgcactgcttattgtagacagtgccaccgccctttacagaacagactactcgggtcgaggtgagctttcagccaggcagatgcacttggccaggtttctgcggatgcttctgcgactcgctgatgaggtaagttgtgggatagggacagagaatgcctactttcagtggctgtgaattccaggagccttgctaggaggctaagacatcagtgcctgagatcatcaagctcttaggaagaagagagacattagttattcgttattttgtgggggaaagtggtggcagcattaaggcttttggagtgtctatggccacaaaattgacatttatcctttccccatcagtttggtgtagcagtggtaatcactaatcaggtggtagctcaagtggatggagcagcgatgtttgctgctgatcccaaaaaacctattggaggaaatatcatcgcccatgcatcaacaaccaggtaaggtgttgatgggatcagttcttcttttcggaatgtcatattaactgtgaagacatgaagatataacattttcatttaagccctgttaaagctactgttgtatagacacttaggaactcttgctaatctaattaacatgctctcgttggtatagatgttttagttcataaaagaattaaaaacccacaagtgtggaagaatgaatatgagtaattgatatgcctctcccctgttatttaaaaaatgtttgggctgggcacagtggctcacactggtaatcccaacactttgggaggccaaggtgataggatggtttgaggccaggaattcgacactagtaagggcaacaaagtgaggcctctgtctctacaaaaaaaagtagctggtgtggtggcgtgtgcctgtagtcttagctacccaggagactgaggcaggaggatcagttgagcataggaattcgaggctgtattgagctatgatcacacatcactgcactccagcctggcaaaagagcaggacactgtcttgaaaaaattttttttctttttttttttttttttttgagatggagtctcgctgtgtcacccaggctggagtgcagtggcacgatctcggctcactgcaagctccgcctcccgggttcacaccattctcctgcctcagcctcccgaatagctgggactacaggcacccgccaccacacctggctaatttttttgtatttttagtagagatggggtttcacagtgttagccaggatggtctcgatctcctgacctcgtgatctgcccaactcagcctcccaaagtgctgggattacaggcgtgagccaccatgcccggcctaaatttttctttttttaatgtttgtttcaatatggacaatccactgagaggggccagggcaaaaatggattctgccaggttggaaatgcactaaggaaaacagtacagaaacattcccagggtccttctaggaagaatatatgtctaaaaaattttcagctctgttacaaagtcaggaacggaattgtttaattataataaattggtgctttggtctgtgtctttgggtcagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaa

SEQ ID NO: 1941 - DNA, 11748 bp, Homo sapiens
agagggcaaggagagagcagagaacacactttgccttctctttggtattgagtaatatcaaccaaattgcagacatctcaacactttggccaggcagcctgctgagcaaggtaacactcatacttttcatgccttgagccaaaatatttattacatttttatgtttctaactagaagtgcttgagctttttttccttccaggtgatgaggggatggaatgagcaaagctacatcaatttttttttaatgtatgaaaataaaaaaggtacaagaggccaagtttagggccactgaaggttcatagaaagatgcaaaatatctgaattactataaatgaatgctattgtcagaggaaaggtttaaggagtgcttcttgaatgaatgtgtacaaatcagcagaaggtaaggtgtgagactcttggaaatgaatactggtagttcaggtgagaaaaataatcaggaacataatagggtgggaggaaatgtatggtttcccaggtattaacaagtattgccaggcatttcctgaactagattggcctaagtaggagaccaatgtttctcaaaatattcactcattttagaatcactgaatgtttaaaaatgcaatttctggattccttcccaaacagccagactctttgggacctgatgatctgcatttctttttaaaaacaaactcgctcatgattctgatttgtattaattttgagaattgccatggtagagaccctgctttgaggttatgttcttgagtcaggattcctggccagggattgtgatgatatatttctctttctgaagtggttcatgcaagaggttgtctgaaggaagagcaagaattgtagtgttattttgtggatacttgagacttataaaaaggctttttattttgtcacatttttgatacatgatgtttggcaaaaaacagacgatagtatttgcagagtgaatgaataagtggaacaggtgtgataatgagaggtcacacttgagcacacagttattacttggaaattgtgtacagactaagttgaagatgttaggagggaagattgtgggccaagtaacggggtgtatgtgtgtgggtatagggtgggcagctgggatggaaatggggggctgctgctgctgctgcaccctggcctcctgaactaatgatatcactcaccagaaactactgttcctgcactgtccaagccaccccaaactagtttgtcaaaatgaatctgtgctgtgtggagggaggcacgcctgtagctctgatgtcagatggcaatgtcgagatggcagtggccggtggggacagggctgagccagcaccaaccactcagcctttgagatcccgaggctggtctactgctgagaccttttgttagaagagaggagatcaagcatttgcaaggtttctgagtgtcaaaatatgaatccaagataactctttcacaatcctaacttcatgctgtctacaggtccatattttagcctgctttctccatgttcatccgaaaagaaagaaaagctaagggtggtggtcatatttgaaattagccagatcttaagtttttctgggggaaatttagaagaaaatatggaaaagtgactatgagcacatatacagctagtctttaaaacagttttatccaaaataaatgtatcacaaaattaataaaaatagttacttgcttgttttgaataattcaaatgatacaaaaattaataaaataaaaagtgcaaaaggccctcttatcaatgccaattctatttttttcagaaattaaacactgttaagattttagtgtgtatcctttcagaattcctgtgatttcatatatgtacaaatacaaacgtatctacataaagggaatcctactatacttgctattgtcattctattctctgctttttcatgtgagcatctttccatgtcactgatgcatacagaaattgcacatatgcatcagtgcatacagaaaattaaattttctgcatggttttccactgtatgtctggaccatagtttatttaataataatgccctttgggtaattatttatattgtttcctgctttttcaaagtaacagcttttgaaacaaatctctctctgtctttatataaatattgttgcattcctgtggaaatgtttctattggataacttcccaaaaggagatttattgcatcaaagataatatattcaaaaattttaaagatattgctaaattgtctagtaggtattttataccaatttatactcctcccaagaatgtatggagatatcttaatttctccatgccttcattaatgctgaaccatataagtagttttaatctttgctaattgaatagataaaaaatatctaatctaagtctagttcttaaaagttctatcttctaccaaaagtaatacacgtctattttagggagtaaaaatcacaagtaaggataaaaaatagtgcagcaataaacacaggagtgtagatgtctctgaacatactgatttaacttcctttggataaatacccagtagtaggactgctggatcatataataattctatctttagtttttttgaggacctccatactattcttcatagtggctgtactaatttacattcctaccaactgtgtatgaaggttcccttttctctacatccttgccagcattcattattgcttgtcatttggatacaatctattttaactggggtgagatgacatctcattgtagttttgatatgcatttctctgatgatcagtggtgttgagcaccttttcatatacctgtttgccatttgtatgtcttcctttgagaaatgtctattcagatattttacctattttaaaatcggattattagattgtttcctgtagagttgtttgagctccttgtatattctggttattaatctcttgtcagatgcatagcttacaaatattttctcccatcatgtggattgtgtcttcactttgtggattgtttactttgctgtgcagaagcttttaacttgatgcaatcccatttgtccacttttgctttggttgccttccacaggagtatttaaataaatgtagtttggtagattttggtatagtaatgcaggccagtgggagtcaggggagaaatgtgtagggaagtgagatagttctaaggatcctacaaacatgccttatgattgacttactcaatgtgaaagtcaatattaaacttgatgagctctagagatggtcatgcattttaaaaagaattactcaaaatattgtcttggaataccagagagcaagtgctttaagtataggctgggaagtaaaatgctaaaggaatgagaaggcatttggggttgagttcaacctaagaggcaggggagccacagggaaagacctagcacctgccacagaagagaattaggaagcagaattgaactataagcaattttgaggtgttcgttgggctgcagttgaaatattttttgaggttaatgagacatttgaaatggccgtgtattgtttaactcttgcatagtcctgcatagggaacaatctaataggatttctctgtgaatcaagtcttagaaatttgcttttaatttttatgaaaaacgcccatttctttgtttttgagacagagtcctgctctgtcatccaggctgggttgcagtggcgtgatcttggcccactgcaatctctgcctcctgggttcaggcaattttcctgtctcagcctcccgagtagctgggatttcaagtgcctgccaccatgcccggctaaatttttttgtatttttggtacagatggagtatcaccatgttggccaggctggtctcgaactcctgacctcaagtgattcaccagccttgacctcccaaagtgttgggatcacaggcatgagccactgtgcctgtgccccaaaacaccaatttctgatgtgtgatgcatgtaagatagaacaaacttcagtaaagcggggacttgaaaagaggctttggtaacagctgtcagcattaacccttgcccctccgtacctcctaatcccacccctgctcaaagtatgttcatctgagaatttgtctccataactatgtgactataaaaattctcatcgattttgttagttgatcaattgagggaaaaacatatgttacttgatataactggtgggtcaaaagaattaacccaggcaaatttgagataggtggatgggatgatggattgaaaatacagctgctctctttccaatcatgtactaagtaatttgggaaagattgatctaattgggtctagagagtacacttcacatggcattgtttgactttttttctgcatcgctagcgatctgtgcattacaactcaaatcagtcgggtttcctggcatatgtaattgccaatgttttttaccagaagagaaacattactcccacctcttcttattatgttacaaactatagtgctaatgaccatcgaccaacagtgactttcaggatgacctgtgtgagttttatctgaaaccatgtgaatttttcatcttaaaagtcccttagaatctcagtctatgtacactcaggtttgttgcaggtttagagttccgtgttttttgtttctaatgtagacacagccttataatttacaacagcattcactaattaaaattgtaagcataattactatccacgatacttattattagtttgcattcataaagctcaaaattcacttcatcctttcaagtagtgaataattagtttctttgggtttgcagctttatcatccttttatgacccatttggaagaaataaacaaccaaccccctggaagactgctttaaaaagctggaaatacattgtccagctagtacaatgaggctaatacaatgtggaaaatattacttttctttgattttagtagcctgtttatctttacatttactgaacaaataactattgagcacctaatgtatactgggacccttggggaggcaaagatgaatcaaagattctgtccttaaagaccttaaggtttttgtggaaggaaataaaactttacatgtatatatttaagcacttatatgtgtgtaacaggtataagtaaccataaacactgtcagaagaggaaataactctatgatcagcacctaacatgatatattaaggtagaagatttaatacatatcttttggaatacatgaataaataattgaatgtatttatttttattatttataagatacatcagtgggatattgatattggtcttaatatgacttgttttcattgttctcaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcacaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccaggaaagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcaagtttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagttttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagccttttttttttttgtatttcagagaaaattcaggtaccaggatgcaatggatttatttgattcaggggacctgtgtttccatgtcaaatgttttcaaataaaatgaaatatgagtttcaatactttttatattttaatatttccattcattaatattatggttattgtcagcaattttatgtttgaatatttgaaataaaagtttaagatttgaa

SEQ ID NO: 1942 - DNA, 6337 bp, Homo sapiens
ttgatgtagattatttatttcttcttttgtgtcagtggagaacattatctatctatatgtatacatatatttatatttatatctacatctgtaaagctatgagaaactaacttgttcatgggcataatccaaagggttgcttgaaggtatataaagaacactaatgtgggatgtagtagatcttgcttttaagttttggccaactgccgaattgttatgttgcacaaaataatcaatttaattcttttgggtgttaatttctttattggctaaatttgtcataaacactttataggttatttgttaccaagacttatataataaatataaacatacctcgatgattattactgcttctgggtgtttaaggtttgttgaataaaaaatcagatcagaaatcctcagtgaagaataaattagtaaattgagtatttgggtaaaatattttcaaaatgtatagggtctagaatgactttatttatcattgcattataaacacttttttctggcccttaattcatgtaactaaaagaaaacataggcattttaaataaacaaaaatgtatttttaaaatcaatgttatgattttaaaaatagattcaaaaattccatacacctgaatctgaaaggcttttgcaaaactaatcaaacaaccttctaagaaaggatttcttggcaggagtcaagatttttccagaaccttttttacggagggatttcattggaggcttttttaagggtaggactctttggggagtgtgtagagctcttgctatctccacatgctcattgcagtaatacttgttgcttcctgctgacagatggatgagtgtgcgttctgccagatccatgcactgagcatggacccagtgcccatccccatgagagcagtagatcatggcgggtttgttgagctcagttgaatagaatggtacccaagtgttgatatccacatcacaagtagggcagcatgtaatccagtagcctgtctcagactcatcttcttcatcatcttcattataggtgtcaaattcatcatcaccatcaaaactatttgcttctgcactgaaacaaaattcttcagagtcttcaaagggagtggaatcccctggatcttctgttgatgtttgactgtttgtgaatgttgtctgctcttcattagtatcatcttcagcacatttcaacatatagaaatagaatccttctgaaacaacttgtttattgtctcctggtatgccaagaaaaacagttccatttcccatgttgcttccaaaccatatcttgctgtgcttaatgtctggggtccaatctggggtctccatctcacgaatttctatcttgttgtcctctaaagagatgatgttgcagatcattcttttttgattttcaagctgatagccaccaacaataacaaattcatcattgttagtttgagtcaggattgcactggagacagagattcctcctggcaagactgtgcaattcacagctgggctacccaggggaagatcaacccttattctgtacaggttggcaggccggatattattggcaagtgaatgtcctcctaaaatatagatggtgtcatttttggcaatagagacatgaaaagatagcccatcctgaagttctggaagaatgtatgatgtagcacacccaaattcaaaatccaccaggaaaacacagggcaggcagtcagctacactattccatttttctgtggttctgtgggtagaaggcatgtatgagcgtcctccaaagagaacacccatacttttccctcggctgtacaccacattaatggaatgaccatatctggcttcaggaacatctcctaccaagtctttctctgtgcagcgaaaagtaacctttttgttgttcttgcaaacaatagacatgacataaatcttatctgaaacctcattgtttggtgttttccctccatggatgatgtattgatgcttttcagactccaagctgcctttgaatgtgcaagtggctgggtagcgaagaggagggaggtagcaggaatccttagagaaaattgtaggcttcagtttgacatggttatgctttacatccagatggaaaactccagtggggcaggatcttttgggccagcctttttgtccaaagaagaaaacttgtccatcaaaattcatcagtgagaagcctggctgaattaaggctatgttattactgactgttaccatctgcagagacatagtttctgatggtacgtagatttttgtctgaaagaattataaaataaaatgacttagagatcgcttcatataatcatcgtatttagattccttcacatgtgaatagcatttttttaagtcctcccacacgcttgcagtgggactgaatgaggaaaatccaaggagttaggtcagtaaagagccacagaacctttactgccattccatccaaggagctgggacatgttttagccacggactatatgctccctaggatttctgggaattgtagtccttttccgtaaagagtcaccatgcgtcagctgaaagaaccacatttcccaagaatccgttctctctgggatgtgtagctttggaaatctgtctttgttgctctgggagaggggactcctggaatgtgtctgtgaataaagactagccgaaggtgcgaagtgactagacgggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacaggtgacccgataggaagcacaactgcttctgttggagtgcggttacctggagaccgcagtctgaagggactcccggcagagatgtcgttacggtgtcctgcctgtctggatgcttaggagcgcgactcaaaactacacccctgacgaccctggaggtgcttggggcgggaggttgaagggggcaccgaggttacaaaagccgtgactgtcttacagaaccgaaagatggatctttgaatccctagagtgcaggggagacattgcctgttaaagatgtttaccacttctacatttagtaatagaaatacagttattaggttttaacgagtgcactttgaaggtcctttgttttcttcactgtttttactcctgtttttagggttcttttagggaagcagagaaggttcctaaacacatcttcttttcatcttcattctaggaaaatagagttagtggctttttcacatctttccagtccaagaacttttgggtaattctttaataattctgtagtaagtaagcagggactaagcatagaagtgtttgaattattcagaatttcatacttgtgttacaacaaaaagaatatttactagatgaaggaagcttgataaatttctattttattattgtttaccttagagagttgtggaatacactccgtgtttgcagtgtgatgtcctgtgcaccaaatgttaaaggaaacaaaacatagcacagatttcttgacttttaagagttaattcttaatatgcttcaaaagcagtataaacaatggctgagtgtggactctgaatgcttactggctggattcaaatcctggctctgccactaactacatgactttgggcaagttatgtaacctctgtgtgcctcagtttcctcatctgaaaactgagataataattttaccaacctcatatattgatgtcagttatgattaatagttgaatatacgtaaagtacttagaacagggatttgcatatagtagacgatagttatgattattttaaaatttaccaaaaataaggtctagtgcatacgcacctgccagtaatggcagttgataaggttggagaggatgagaaggggctttaggatatgggaatcaggtcagtgggtatagacagataaacatttgaactaaaagaattggataaacatatatgatgagggtgctggtagtagttaatttattaacagaagatagttaatattttattcttcttgtcaccctttgtctaactggggataatcttggtatatattcactgggctgttttgagaaataaatgggatagcacgtgtaaatcacatagaacagtgcctggcacataaacactcaataaatgttaattgatactataatttatctaatttatctttattcctcctgcaaagattccttggactatttagaatctctggtcactctaatgagatggtagtgttttttttttgtttttttttttttttgctttaaagaacttctgtagatcagctgtaatttactgctaaataatctcttgtagttattattttcagtctacttgggagactcgtaagggggtgatctttcaacaattatctggtgggttattaaagcaggtgaggaaatggtgtctcagaaggattattatcaaagttatgaaaacaagcctgtctccctcagttgtatattcagcaaactgccctgcttataaaataatctaggcagtgttttatttatatcatggcctacccaagcctacatgagggaaggcatctgagcaactatgaaaaatgctattcatagaaactaaaaggagacattattgaccctcacttcagaaaactgtaggtgattacactcagcctgagtgattatgatcagagagttgtcccattttgggtggggggaacaccaaagccaaggcctgcttgtttcaaacacctgtgatgactgttattgagatacaaggcaagccatacagtggtaatggattccagatccaaagggatttttcaagaacagttgttttaaagcaatgtttttattgtcgcctcttggtttcattttaaggttgctgtaggaattgtggcttctcgtaagtgaaaacatgattattgtagattacacagaaacattttcttgggcaagacataaggaggattgtccatttttgtagcttagtctaggcccctaaagatttttgaaacagggcttttgacctgttttccctttgatgctctgcttttggctcatttcataatttcaaggccctaaaaacagtggtaaagtttcttattgctaagatgaattacctcctcttgtaacatggttcaagtgtgagtaattaatttttagattactcactttaaccagatgatgtatgcatttaaagaataaacaggaacattgaaagtgttttcacatgattttgccacatttggtttttgaaattttgctttatcaacttgaatatatttttcactggagtagaccattgtatctcttccatagtttcaatatgactgtattagtcacaccttggtttttaaaaagagtttttaaatgattatactatatctaaaataacctactgaagtcttttccttttaataggctacataaaaacaggcagatttaaaagaataagatcctgttcttcagctgagggaggcttcaaggtcaacacattaaagattctttgtaaaggacagaaatataggaccaataaatatatacaattttcccaaccccatgctaacattcttcagcagggagattttcatttattctctctgatgctagggcatagttgagtataatgaaaggactcatagtatgaggtctgggtttatagttcctaatatctgaactgactttttcttttccaaagaaagatactgtactgtgaaacattaaatcttgctgatccgtgctggccatgttttcttgattgctccagagtagcaagtaacctcatgtaagtaacttcaggcatttaatgtgtgaataacagtatcttgcactgttaatcaggtttgaggcatatattattttatttctgctggcagtaaaaccaggattaggtcttccttcctgtcttaggccagagaacgatttatgtacgaagattaataatagtgctctaaaggcctaataattaaatccctgaagcagccagagaacagaaagccccacattttccaaattctactcatcccttccctatctagacaccaaatccacttgtgactaacacactgccaaaatgtggcatcttcattcccttaaagtttactaacataggctcccattttttagctttggtagaaatgaaggtatcagacctacctgaaggccagaggggctgctcacgcctctctgaatctttgccgctaaaccaggtattaattgtcagcacttggggaagattcactgactgcccactatgactgtggcaagcagaaggctgactgtaaagagagtgtgtatgtgtgcctacagatgttcttatgaacactgatctaat

SEQ ID NO: 1943 - DNA, 6337 bp, Homo sapiens; identical to SEQ ID NO: 1942

SEQ ID NO: 1944 - DNA, 6337 bp, Homo sapiens; identical to SEQ ID NO: 1942

SEQ ID NO: 1945 - DNA, 22902 bp, Homo sapiens
agctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggtgggcacaggctggaggtggctggggaacttccggtgggaagtgggccccgcaggacctggccttgcccctggccagaagggccttggagagggggctttagcctgccctccctctaccctcctccccatcagtttcctcctttggtacctgctggcttccagagccatcttggggccctgagaactccttgggctggctctgtgctgagatggggctaggggactcgcagaggacacagggcattgaacttggagacctcctgggctggtgggagacagacgtcagttgacctgagaagcaggggtacttgcctcttctcttgtcccctgcacctagggttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttcggttctcatccaaccattttttggccaaggcccttactcttccttccacctggaccactcttccccactggagcttgacacgtgcagcttctcctccttcaggtcttagcttcagtgttaccccctcccagaggcctcccctggtctccttaacctgtttatttccctgccagcaaggatcgcaatctgactttttttttttttcttgttaaacttgttcattgtctccccactgggcagggagatccataaggagaggggccctgtttataaatctctgtgggattccagttcctgggacagtgggtggcacacagtagaagctcaataactgcttgttggataaatgaatagaaatatgagggaccctgggaatgggaaggacaaacaaccaaatgagcctagtgtgaggaggagtggggaatattagagaacccctcccggagaaagggacttttagtctgggtgctgaaggatacgtaggagttcaccaggaagacagagaaagcagcacacacaaaggatcgcctcctttcctaccccattactctcagctcctgaaaataaaccctgtgctaactggctcctgctgtactggctttcagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggtgaggagtgcatggctggcctgaacccaagggacagcaggacaggatattcttgcctgtagaacagttcttcctaatggcacgttctggcttcaggaggcctggcttctaaccctagttatgtcattaatcaactgtgaaatacagagcaggtcacttcacctctcagtgtgtcctcattttaaaaatcagaccgtaacagtagctatctcatagggttgttaggaggtgtactgtattaggatgttaggccttatacaacagaagaaaacggaacagtgacgtaaacaaatttgatggcagggagtccagatagggaggttctgctcccgacagtcctcagaggctcatattgtttctctcaccattctgccattcattcccagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgttattttttgactgctttttcattactggatagtaaggcaatagttttatggtttctgatttttggttctcttggtgggtcccatttggtttttcttaaaacagttttatttatttatttatccttacagttcgaccatttaaagtatacagttcaatggcttttagtatattcaaggttgtgcaaccattgccacaatcaattttagaacattttcatcatcctgtaaagaaacctggtactcattagcagccagtcctcatctctctaccttttccctaactccccaaccttaggcaaccactaatctactttttatctctagggatctaccttctggaaattccatataagttgaatcatgcaatatgtggccttttgtatctggcttctttcacttaggatcgttttcgagattcatccatgttgtagcatgtctaacaacttcattcccctttttttttttgacatggggtctcttgtctaggttgaagtgcagtggtgccatcatcgctcactacagcctcaacttcctggattcaagcagtcctcctgccttggcctcccaggtagctgggactactggcatgtaccaccacacccggctaattttttttttctttgagatgggagtctcactctgtcccccaggctggagtgcagtggcgcgatctcagctcactgcaagctccacctcccaggttcacgccattctcctgcctcagcttcccgagtagctgggactacaggcgcccgccaccacgcccagctaattttttgtatttttagtagagacggggtttcgccgtgttaaccaggatggtctccatctcctgacctcgtgatccgcccgcctatgcctcccaatgtgctgggactacaggcgtgagccaccacacccagccacacctggctaatttttagaaagtctgtagagataaggtcttgctttgttgtctgggctggtcttgaacttctggcttaagcagtcttcccacctcagcctctcaaagtgctgggattacaggtgtgagccaccatgcccaaccagaactttattcctttttattgccaaataataatctattgtatagacatatctcattatctttactcattaaatcagttgatggacatttgggtgtttctattttttggctattataaacaatgctgccgtgaacatttgtgtccaactttttgtgtggacacgttttcatttctcttggatacacactagcagtggaattgctgggtcatacagtaactctatgttactttttgaagaaatgccagacagttttccaaagtggctgcaccattttacattcccaccagcatatatgagggttctagtttctccacatcatctctaatacttgttgttgtttatctttttgattatagccatcctagtaagtttgaagaggtatctcactgtggttttgatttgcaatttcctaaccatttgatgacaaatgatgttaagcatcttttcatgcacatattttctttggaggtttgcctattcaggtcttttgcccattttaaaattgggtttatctttttttttttttgagatggagtctcgctctgtcacccaagcaggagtgcaatggtgcaatctcggctcactgcaacctccgcctcccaggttcaagtgattctcctgccccagcctcctgagtagctggattacaggtgcccaccactacactggctaatttttgtatttttagtagagacgggtcttaccatgttggccaggctggtcttgaactcctgacctcaggtgatccacccaccttggcctttccaaagtgttgggattacaggcatgagccactgcacccggctgggtttatgtttttatattgagttgtaggagtactttattcattttagctagaagtactttattcattttagcttatcagctacatgatttgcaaaaattttctctcattctgtggattgtcttctcactttgttgatggtatcctttgaaccacaaaagttttaaattttgatgatgtccagttagtctatgttttattttgttgtttgtgcttttggtgtcatatctaagaaatcgttgcctcatccaaggtcatgaagatttacctctatattttcttctaaagattttatggttttagctcttacatttaggtctttggtccattttgatttaatttttatataaggtgtgaggtaagggtccagcttcattcttttgcacgtggatattgagttgtgccggcactatttgttaaggctgttttcctctgtttaatcatcttaaccctttttggaaattaattgaccataaatgtgagtgcttatttctggactctcatttctataccattgaactataatatatatctgcccttacgccagtaccacactaattactatagcttcatagtatttgaaatcaggaaatacaagttctccaacttttgttctttttcaatattgttttggttattgcaagtctcttgaatttccatataaattttacgatcagcttgtctgtttctgcaaaaaaaaaacaacaacaactgggaattttggtagggatttcattgaatctgtagatcattggccacttgattttaaacaaaatattgagatatctacttcttgaaatgattgcttgagacagtacctgtgtactccttgctatgaaaaatgaggaagttaacatactcatcttccacctttccttttccttactttttttgttgaagtatcattgtggacactttcccagttgacttccacttgatcccctgaattaactaactggcactggcgtttcctttgtaaaatgtacaatgtcagccaccatcttgctactaaagtgtggcctgtggaccacaacatggggggaatctcaggtctcacctcagacttgctgggtcagaacctgagttttgagaggctctgggcaaccggcacctctcagacctgctgttgggttctcatcgatggacccgatgcttcctagcaaatgatacctgttgtatgtgttattggtaataacatagtttacttagctattacattaattaataaaacatgagcgctgaaagagttgtttctgtgaaaataagctgattgctttaaaaagataagagacaaatcaccaaaaaaaaaaaaaaaaaagattaacacttttgggtgagacagtagtaaggaaatacagtaaaaatccagaagggctctgtgctctgatgcttcaggagtgtgtctaagttcttgctcgctttaaagaagctgctactagaaattatagatcatgattatcgatgtggttcatacaaaaaaaaaaaagaaaaatccctgggaaactccaatgagcaggtataaactcacgctgggcatggcggctcagcactttggaaggctcaggcaggagaatggcttgaactcgagtttaagaccagcctgggcaacatagtgagaccttgtctctgcaaaaaataaaaaaaattagccaggctgggtggcacacacctgtagtcccagctatttgagaggctgagatgagaggattattagaccctgggtggttgaggttgcagtgagccatgatcatgcctgagtgacaaggtgaaaccctgtctcaaagaaagaaagagagaaaagccattggctgtacacctagagactggccagtgaatatgcatttatagtatgtaagttaaaattaagtgtttaagctttgtctgcagctgtttttgtgattctctgctgttcaccagcgatcctgatgtcacattggatgagagagctccagctgtatttttttgttgatagtgttaagattatagctttaaaaaattttgttttctaacataattaaggcctttatgctttgcctctaggttgattctaaaagtgtaacactactagaaaggatttatagtattttgattatggaaatattattcactatagaataactagtgcagttgaaaccatatgcacttttatgtttcaaaacccttattgctggaagaacattttggggttaagatccagtccttttcattttttacttttcttctattctcctgtatcagactcatctatttttgtttttcaagaacttttcacgtggaaaatgtggtaaacttttagagtctttgcatgtttaaaaatttctatattttgctctgtcaattcattgatagttgactgggtattcaaattgtttacctgaagaattttgagagcattttctggactgcttttaaataaatttcagatattattttatccttaaatactttagtatgtgtcttcaaaaaattaggacttggcggggcacgatggatgatgcttgtaatcctagcactttgggaggctgaggcaggtggactgcttgaacccatgagttcaaaaccagcctgggcaacatagtgaaaccttgtctctacaaaacattagctaggcatggtggtgcgcccatctagtcccagctacccaggaggctgaggtgggagggtcacctcagtccaggagattgaagctgcagtgagccaagatcatgccactacactccatcctgggtgacagaagtgagaccctgtctcaaaaaaaacaaaaacaaacaaaacccctcaatactattatcacaccttagaaaaggaataagaattccttaaaatccgctaatgccctgtttatattcacattttcctatttcattagtgctttttacaattggtttcttcaaatcaggagccaaacaagatctacatgtagcatttcttactatgtcttaagtcccttttactctcctctatttttatgccactagttttttttttaagaaacctggtcttttgacctctagaattttccccatattctggatctatccattacctcttcatggtatgtattagaccactctagcattgctacaaagaaatatctgagactgggtaatttgtaaagaaaagaggtttaattgactcagttctgcaggtggtgtaggaagcatggtcctgacatttgcttggcttctggggaggcctcagtgaacttttactgaagcgggagcaggcacttcacatggtgagagagggagcaagagagagagttggtggggaggtgccacactttacaacagccagatctcacgaggactcactatggcgagaagtcactacagtgagcgcagcaccaggctgtgagggagctgcccctatgacccaaacacctcccaccaggcctcaccttcaacactgaggattacagttcaaggtaagatttgggcagggacaaatacccagactatcatggtgtcatttactatctcccgtttttcctgtaactggtagttagagataaagtttcaattagtcagcagtcactttttttttttttttttttgagacagagtttcactctgttgcccaggctggagtgcggtggcgcaatcttggctcactgcacggtccgcctcccgggttcacaccattctcctgcctcaatctcctgagtagctgggactacaggcgcccgccaccgtgcctggctaatttttttttttgtatttttagtagagacgggttttcaccgtgttagccaggatggtctcgatctcctgacctcgtgatccacccacctcggcctcccaaagtgctgggattcagcagtcacttttaatgtgcaggaactcttcctcattttttggttgcttcatgcctttccttgctttctgaatgcagtgttttcccaaatctctctgaaggtactagttagacttcactgttgcttattgttccataccctaaatgatctctgtttcctttggggtcggttctgttttttcatcttttcatgcttttgattttccaaacatgttggaggatcctcaagaaagttaaaaccactttctctggaataataccatgtagatttaaatcctgcctctggctgaacacagtggcttactcctgtaatcccacttcgggaggccaaggcaggaggatcacttgaggccaagagttcaagaccagctttggcaacatagtgagaccctgtctctacaaaaacttaaaaaattagccaggcatggtggcatgagcctgtggtcccagctacttgggaggctgagatgggaagagcccaggaggttgatactgcagtgagccaaggtagcactactgcactccagcctgggccacagaaagagagcctgtgtcttaaaattaaatcaagacatacaaatgaatcctgcctctaacagttattagttgcttagtttggcagagtcactggaacctatctgtgcctcacatttttatctgtaaaacagggatacagcagtacctgtctgatgggttggttgagaggattaaatgagttaatacacatgaagtgcattaaatagtcttagcacgtagttaacaacaacttctggtggtttcactaaggagcaggggagagaagacagaagaggttggagaggtcagggaggtgccagatcatggaggccctcgtgtgctgccacgagttgattctaagagtagcgtggagccattggaggggcctaactggtgggttctaataaaggaagaagcatgggtggggcctaccccagactggggtttgtgtgtgtgtgtgtgtgtgtgtgtgtgcatggccatgtgcctgtgtgcaaatatgtacatgtctgtagccggtggctgaggctggacccctggccagagcccatgctgagcccctgctgttctctgcaggctgtgggtgagcgtggaggatgctcagatgcacaccgtcaccatctggctcacagtgcgccctgatatgacagtggcgtctctcaaggacatggtgagtgaggaggcggagggcgacactggggtgaaggctctccctttcactcctgcttcctctctctcctctggccctcccttcccactctccctctctttgcccccaccaggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaaggtgaggctctgccctgagcaccgccggacccagcgggggccctggactcacttgagggcatagggcaagcaggggcagagcccctgggtttttagtcagggactcacccagaggaccctatccaagtggggaagagaggacctaagacacatgggagggagcatttcagggacccatcatgagaacagctggcacggggaggggtggactccgtccaggctccggcattcccagctgtgtgaccttgggcaaggttgctcctatctgctgcccagtttgctaaaatcataaattgggtatgacagtgatcgtgataactagtgtttattcttaatttttaacttctgaaatgtttcagacctacagaaaagttgctaaattttacaaagtagtacataaagaattcccatgtacctttcatgtgggttttaccacatgtgctttctttttttttttgagacggagtctcgctctgtcgcccaggctggagtgcagtggcacaatctcggctcactgcaagctccgactcccgggttcacgccattctcctgcctcagcctccggagtagctgggactacaggcgcccgccaccacgcccggctaattttttatatttttagtagagacggggtttcaccgtgttagccaggatggtctcgatctcctgactttgtgatccgcccgcctcggcctcccaaagtgctgggattacaggcgtgagccaccacgcccaacccacatttgctttcttttatcattctctttctatataaaattattttttttctgaaccattttgagagtaagttgcagacatgatgtctctttcccctaaataattcagtgtgcatttccttgaaaagaaaggtcattttcttacattactgggtataacaatccaactcaggaaactaacgctgatacagtactggtatccagtctacagatcttactcagattttaccagttgtcccactattgtcatttatagcaaaagacttggcattctgctgtcatgtctcagtccctttcaaagagtccaggccagtttcttttttttggcgggggttgggggctgatgtttcctccggagtggatcaagtcactgttttggcaggaccgcctcagcggtgctcttgggtccctcttggtgcatccttcaggaggcacggaagggctggtgttgtgctgggttttgaagctcaaaggacatagaagcatttatcggtggaatagggaccctgaccctgggggagccaggatgcccacttggccagatggaagctggaggtacccccagggaggagggagaggatagggggagggtctgcctggctggctcagggagacccacccccatgggtgtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtccttggcctcagtatcctcttctgtgcccctcccttgcctcaccctgcccagtcgggctcacagcaccctctgctcccaggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgccttagccctaccccgcccccatcgtgacacacgcactaatgacacagacattgatccccgagtgctccccattctgatctcacccctggccccacctgcattccccttggacccggtgctgcccctggccaccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtctttgtgaattgtgtcaaatgctacatacagtacattaagagacaacaggagtccttcccagagagggtggtctggaagcttccaaggaggtagccccagagcagggaccggaaggcctgctgtaggtgtggggtgtgggcctggcctgttggaggagactgaggaggtctcttggtggctggagcagagggatgaagggggtaatcagagcaggatagagaggtgttgggtacgtgagcagcagtgaggagttgggatttgttctgggtaggatgggagtcactggggagacatggctgctgttctgagatagactctaggggccagatggatgcagggagcccagcgaggaggctcctggagtcacccaggtgggggatgtggggcctggaccagagaatcagagcggcagtatggaggcagggtggaggccttggtgatgggttggtgagagggatgggaaggaaggagatattgaggagaagtccacctggggtgactgagtgaggcccctggggtcaggccttgccatgtgagggatggagtccccagtgaagggggttcctatgatcctaactcttttcccctcccctcccctagggagtgcctgcagggcaccatccgcaacagccaggaggcggaggtctcctgccccttcattgacaacacctactcgtgctcgggcaagctgctggagagggagatcaaggcggtaaggcctcagggtgggagacataccccaagtcccaactcctaaggaactgggccctgagcaggcagcagacatctttcttttctttcttttttttttttggagatggggtctcactatgttgtccaagctggtctcaaactcctgggcttaagcgatcattcatcctcagccccccagacatttttcaagagctttgtccatgtggggtgttgagaccccaagcagaaaaagaattgaggggagtagctagtcaagaaaccacatctatgaaggaaggacagcagagttgttaagaatcagggactcggctgggcgtggcagctcacacctgtaatcccagcactttgggaggatgaagtgggcagattgcttgaacccatgagttccagaccaacctgggcaacatggcaaaaaatattcaaaaaatagccaggcgcgggggcatgcgcctgtagtcctagctacttgggtggggtctgggatgagtgggctgaggtgggaggattgcttgagcctaggaagtaaggttgcagtgagctgtgattgtgccactgcactccagcctgggcaacagagtgagaccttgcctcaaaaaaagaaaaaaaaaattagtcagggaactctggagcctggtggcctgggtgtgtgaccacaagtcagatatttaacctctctatgcctctatctcatctctgttagagtcagagttacagcttctatttccaggattgcaaagattacagtagaggatatgtgtatagaattcatagtagtacatccaggcgcagtggctcattcctgtaatcccagcgctttgggaggccaaggcgggtggatcacctgaggtcgggaattcgagatcagcctgactaacatggagaaaccccatctctactaaaaatagaaaattagccgggtgtggtggcgcatgcctgtaatcccagctactcaggaggctgaggcaggggaatcgcttgaaccccggaggcggaggttgtggtgaactgagatcgcgccattgcactccagcctgggcaaccagagcgaaactccgtctgaaaatatatatatatatatttagagtagtgcttgtcacatagtaagcctttgttgttgttagcgcttactgtgtaacaaatcactgcaggctcaaaacaacagtcatttattcagctcataaatctgcaagttaggacagttggccctctgtatctgtgggtaccacactggagaattcagcaacggtggatagaacatattcttacaaaaaaaattacaataaaaaacaaatttaaaaaacaatacagcataaactatttgtataacatttatgttatattaggtattataaataatctacagatgatttaaagtgtatgggaggatgttggtaggttgtatgcaaatactgcactattttatataaggggtttgagcatccatggatttgggtatctgcaggggtcttggaaccaattctctggataccgagggatgactataatttgggctggacttacctggatggttcttctggtctgggcagggcctcgctgatttcacctgggcctggctggtgggtcagccgcggtggcctggtttataatggtctcatctgtgatgactgggatgactggggcctccttccacttcaatgtctcacccaccagcaggctgcccgggccttctcatgtcatggtggtctcaaggttccaagagcagccatggggagccccagtgcatgtgtactttctaagtctgctcatttctcacttgacactgtcccattggccaaagcaagtcccatgctcaagcacagagtccattgggaagggaccacccaaaagtgtggaatcggggagacagaaacaaattggagtcaccactccgccagtctgtcacagcgttatgtgtgtctgcatacgtgtgtgcttgccgctggcgctcttcatgaattcgttagcaggttctctgcctggctgctggtgatctcgagcaagttgtttcccttctgtgggactccatttccttatctgaaaagtggacagttgggcttgattcatggttttcaaactgctgggaaatgaccttcccagacttgggcactgtgggttcccaggccaaaacatggcagccgaggcccaaatgggagatccccacaaaacacatacacagacctcctctttatttctgtcccccctgcctctctcctatgcccctatttctcctgagaatgctcccaacttcaccaagtgtttatggagcccaagaggttctgcccctggggaaaagggggaggcagaagaggtagaactttgggagttcacagctctgatatcaggagcagccccatttttctctgttgtctctgggtggttgctgaggctccttcgctctggcctggagagacctcatgaccagtcattccatatgtccccagcacccatagccatttgcttagaggtttccctgtggagtccaccccagccaaggggcattatgctggggccaggttcatgccaaagggctgcatgaacttccctggagcccactggagttgatgtgagtctcagaaaatggtcaagtgtgacagagagaaggaggcagggatcagccaagtaatgtagtggaggttgtttttacaaaaacagaaaaatatgcctcaccacatagaaccagagcagaaatcagagagaaaatcacccacaaacccaggaaatcctccaattgcattttatcttatttccttcagtatctctgggcaaattttttttttttttcctttttgagatgaagtctcactctgtcatccaggctggagtgcaatggcgcgatctcagcccactgcaagctccgcctcccgggttcacgccattctcctgcctcagcctcccaagtagctgggactagaggcgcacaccgccatgcccagctaatttttgtattttcagtacagacgagttttcaccatgttggccaggctggtcttgaactcctgacctcaggtgatccacccacctcggcctcccaaagtgctaggattacaggcgtgagccaccgtgcccagccagatatgattttttaagtcaactttacttaagtatactttgcacacaataaaatgtactcattgtaagtatgcagtcaggtaaattttaacaaatgtaactctcgtaaccaccaaccactgttacatataacataggcatgatttctgcctcattgtaaccagcatggatacaatcgctttagcttttgttattttgctatagaatttttctaaagattattacaaatctcaatagcacatatactgtttatacctcttagttctagtttctcagtttgtaatactccttcaaggaatgttttgcatggtgtattcttttttttttttttttttgagacgaagtctcactctgttgcctaagctggagtacattggtgtgatcttggctcactgcaacctccacctcccgggttcaaacgattctcctgcctcagcctcccgagtagctgggactacaggcagatgccaccacacccagctaatttttgtatttttagtagagatggggtttcactatgttggccaagctagtcttaaactcctgacctcgtgatgcgcccgcctcggcctcccagagtgttcagattacaggcgtgatccatcattcctggctggtgcatcttatatattattttcttgggataaagttaaagaagtgggatgggtaccaaagggtcagaaaagtttgggatggttgaaacgttattgccacattgctttctcagtgctacgtactagcttactagtttgtttaatttttattttttatttttgcgggtacatagttggtgtatatatttctggggtacatgaaatactttgatacaggcatgcaatgcgtaataatcacatcatggagaatggggaatccatcccctcaagcatttatcctttgtgttacagacaatccagttaacctctcttagttattataaaatgtacaattaaattattggctacagtctgttgtgctatcaaatactaggtcttactctatttttttgtaccaatttgccatccccactcccctgccacgcctcactaccctttgcagcctctggtaagcatccttttactgtctgtcctcattagttcagttgtttcgatttttagcacctgcaaataagtgagaacatgtaatgtttgtttgtctgtgcctggcttatttcatttaacataatgacctccagttcttccatgttgctgtaaatggcaggattgcattcttttttgtggccgaatagtactccattgtatatatgtgccacgttttctttataggatactagtttaatcatgtctttcccaacattgcttattatttatgttcttttctttattgtgagaaaatagacataacatttaccattttaaccagtttttagtatacagttcagtggcattaagtacattcacactgttgtgcaaccatcaccaccatccacctccagaacttttagaaattccccccactttctttcactttctttttacttttcttttccttttttttttttttttttttttttttttagctaggatttcattctgtcacccaggttggagtgcagtgcatcagtcatggctcactgcatccttgaccttctgggctcaagcgatcctcacaacccagcctcccaagcagctgggactacaggtgtgagcaccacacctggttattttattttttaaaaaaattttttggtagagatgaggtctcactgtatttctcaggctggtctgaaactcttggcctcaaggaatcctcctgccttgactgacctcccaaagtgctgggattacaagtgtaagccaccacacctggcctaaaatccactctttgaatggagtttttcaacactatgaggattacatgaagaaaagagcctggggctgggttggagtttctgggctgggggctttctggagggtatttagtggtcaagggtcatatgtcaggtgttctgaatcctgagcagcaaggacatggtgtgttggcagctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggtggggcctgcagggactccccccacctagtcactgtcatcttgcctggagctcaccacactgcagtgcgtgttctcctgggaagggagctgtgacactggcctgctggtcatgacttagagctacatgtcagtgggagagtgtggcttgagcctgaactgagccctggccccacagacggagtcccagccccagccccagatggagcctcaaacctaggcagccctggttcacaatggagccccgaccctgggccagtctgaccccagtcacagactgaatcccagtcccacattgagccctgatcccatccaagtccatagacttggcctctgaccaaacctgaccctgcacttgtcacttaaggtggtcccatattcagctcagaccctgaaccgagctctgaccctggcttctgactgaatctgtgacagactaaggcctgaccctggccctataccacgtctccacccgtgtcctcaactgagtgctgaccccaaacctagacagccctacctgatccttcccccaggcctgtccccgccgcttcatctcaaaagttgaaggtgaggagccggtaaacaggtctggagcctggtctcagactcagcctgagcaagctcagtctggggtcattgggcctgtaaccccgggcaggcccttgttagggatgcagggtctcaccctaggggtataagggatttctgtgcccatcagaacttaaataagctgggtgtggcagcacatgtcagtggtcccagctactcaggaggctgaggtatattttgctgttagcatatgtgatgaccttgacttcacctccctggcgccaatatcctcttctgtaaaatggcttatgcattacaaagtgaggtcctgccagtgactacacctagaggcattaagtgcctttgtggactcctgccctgcacctcacctctcccagcttcttaaccccctgaggaaccttcttaccttgagtccctcacccgctacaggccatccatgagcagatgaactgcaaggagtatcaggaggacctggccctgcgggctcagaacgatgtggctgcccggcagacgacagagatgctgaaggtgaggctgggacagggccgaggcctagggattttaagttctgggatccaggtgggggctgggggcttcccagtaagggctgtgctcacacatccctggaggctctgacctcccttctggctgtcactcccatccggaggtgggacttaggccgaatggtcatgtcaggaagagcgtctgggtggagggtggagaccacaggaatgaagagggggttgctggatggagcctggcctggcagagccacacaggagagactccacagctctagagggtcaccaccttctccctgccatggggaggggccaggctgggtgactgccccagccccgccccagggccagcacctgccccactccaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctggggtgagtctttgctcgtggtggtgtggagagggtgcccttgtgggctttgccttagaggagggctgggaaaactacagcccatgggccatatccaacccagcacctgaatttgtacagctcccgaggtaagaatttttttttttttttttgaaacggagtttcactcttgttgcccaggctggagtgcaatagcacaatctcagctcactgcaacctctgccttccgggttcaagcaattctcctgcctcagcctcccaagtagctgggattacaggcatgcgccaccacgcccggctagttttgtatttttaggagagacggggtttctccatgttggtcagactggtctcaaattcccgaccgcaggtgatccacctgcctcggcctcccaaagtgctaggattacaggcgtgagccaccgggccgcaagaatgttctttacatctttaaatggttgaaaaaataccagaagatgactattttgtgacgtgaaaattacatgaaatccacgtttcagtgtccgtaggtaaagtgctttggagcacagccgtgttcattcattcacatgttggctgtggttgcttttacactacagaggcagaggccgtatggctgcccggcccaaaatgactggccctttgcagaaaaggtttgcccactcctgccctagaggacagcaagtaaaggttcgatctggagtcagaggtggattggcccctggctctggcacatactgactgtgtgattaggctgcctgccactcacctctgtcagccccatttcctctgtgaaatggagatgatagctgggcttatctcaggcttgttgtcagaatcaagtggaaaaattgcaagagaagtgcttagagagcctgtcacttggtgagcacccttgcagatggtagctgtcgttattaggggtgtgctctggaattgggggcctgttgctacgttcaggtagactttcagacaggtggaggcagaggaaactgccctctcgcatgctgacatgtctagaatatgcagagtggtcagatcctctccctggcctgttcccggatctaggcgtgggtagactgagtgctgtgggagcccagaaaaggcctcagtgactctccatcaggtagctgaggctgaccaggccattcttgcaggaggacctgcagaggcaaaggcccggggtgggagagcgctcggctgtgggggcagtctctgcactgcgctgacattctcttctcttcctcccatcctctagggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 1946 - DNA, 22902 bp, Homo sapiens; identical to SEQ ID NO: 1945

SEQ ID NO: 1947 - DNA, 6654 bp, Homo sapiens
tggtatttaaaatgttttaatgtatatgtgttatgggtcataggtactcattagtatgcttcataatttattcacgttagatatactctttatagatatcaaatattacatattataatttcttaaaatctgctgtggtggaaataaatgaacacatgaagtctccctgaaagaaaatcagtgtttcttgggaagaaccaagattccctgacagaagctaccctatgtagaggacaaagtaggtcttcaataaatattagttggtttactgcttttcccaaggatacatctggagggtctgcattcctttctcattggtgccgcctgaccacagaactagctttttccgtgacatctaacctaaaccccgcagtcctaagtcctgacacgtatgacaagatgctgccacctggtggatacagaatagatttaatgaaatggctaggaagtctttcactctagttggtggaactggcaatagggtgagagggaagcaggaatgagaagacaaaaattaagaaacaggaaaaggaaggagctccatctctaatatggaggtagaaaaaaagggactatcatctaaatgagactgaagagtccctagaggagaatggcttccctctccttccttctgagactagaaacgaggaaagaggctacagcttgtattgagggaaatgcaagactgaggagaaaagaaagcaggtctagctgatctcaacttagcaagctaaaataagagtagcctggtgttagcggccacccaagcaactccctgctcctagtttccacttggggaatccatgtgattttggggaggctgacccccacccttttccccaaaggtgttgtccatgatatagaataagcaaattagcatgtatcatcctcctggccacagtgattggtcagggtggacatgtgacccaggcctaatcagtgtgaatattagggcttttgctgagatttctggtacaaagatgccttctttttctgattggacataaatggggaaaagtgtaatcttaggaatgctggcagccattaagtggcccagacttaaatggtcctacagaagatgcaacagtgagaaaaaagtcagtccggtatttagagacatactgaactactgggtcaagtcttcacctggagccagcactacctatggactttctagttacatgaaccaataaatcctttttattttaagccagtttgaattaggttttctgtgatttaaaaccaaaagatccctaacctatatattcatcatacttagcccattcctaccttcccacaggatagcacagggaatacaggtaaggtcactacagatttattggttacactaaagcccagggtatcaagctgaaaaggtcagaggcagcaaccaggtactaagtagactgggtgactcagctgtctgtacagaggagaatggacttccttaggaaaagaatagccaaatgagaagcaagtgcaaagaagggcctctactaggcaaagttaacgtagggatataaacactcttccccacagacctgtatcatgggggtgttgcttttgggtctttatgctcctgggataaggaactttgaagcacatgctcctttaagtctttattaccctgtggtgcagtgtctacctctccctttgccaaaggaaaagcctccttttggcttctgctgcccttgatgacactcacttttgaggggaccaagggaattttatcttctgcttctttggtatgctgggaaccggggccccttcctcctttggaaacagtaccatctccctgaccctgggcaagtactgcccccttttcagcctctcccattggccctggcctctctgcccctccagctgagttgccttcccctcctgagccccatgtctcccatggtaaccttgaggactgggcagattccatggcagctgctgacttgagaggggtagaattcctttccccacttccacctgacttttttcgagggcgcccccgtttccttttggcatcacttgctgtatcctctatatcctgctttgctgctttagctggtggagcctgcccactggcctcactcacaggtacttcagctgtcctcttgacacccttgtcatgtggtccttggtcaccacctatgcctacctctctgttctctgtgccccggggctgagtgagtcccccaggtggagctcgcccaggcccaggtccaggtccaggcaaagcaggaacagttggtaagatcatgttaatgatgggcacagctgctgggggtgccccggccctactagacagaggcagtgtagccactttcagggcacctgaagaaagcctgggggccagaataggtggagagactgggattggcggaattagtgagcgaggggcccggggaaggagcagaggcagccgagccactagggcattaacctgcaggttattggctcctggggccgagctctcaactacactcttcttccgctctccacgtgcgagaggaccggccccagttcgggcttccagatccttaggaggctaaaaagtaaagagaggaacacagtaaggtgtgaagaatgagtattgggggaaacatagacgccagaggcacaggaggtggaaaagcaagggacccaattggagaaggatatactaagcccccagcccaggacagcaaagtcagggccactgacttccttacctgggccagtctctctggcttcttgtgggctccaccctctgggttctctaaaccattctttggtttagatgaccgttcccgaggtgcatgttcgtcctcttctgcagaggtaccaaaaaggtaatagagtgaaggtgaggaggaaactgaggaataggggagtgaggcaattctgattgactgactggtagagacaggaaatggggtgctaaagcatgtcttagaagggtctccaggaagagggggcaaatccaaggtgtctctattctagtgtgtgggagggccactgaagctgaaagtggctcagggttgctgagacataagagagggtcaacacaccagcgagccccatggccttaagcacatgggcatgtgcagatcgggcagagatgagatgctgctgtagcaggaagcgggcgacctcaacgatggaactgaaggaccgtttcaggatccgctctgcccagtcacaggtcagggcacacgctgcctccaccagttcatctcgaggtgctggggttacttctgggcccatttctggctgaagtggggaaggacatgcccaatcacactccaaattaaagaacccttgcctcctctcttgtcagagatcaaagactattgaccaaagctgagaccagactggggatgggagtagcctctacctatcccattgcagaagcccacaagttctcttcatcctctgcctcagctacagggttggcagaagggaacatcatacctagaagctatgtacataatgactgaggctgttagccctcaaaacatgccccaaagacctctgacttttacctgggagagaagagtggaattggaaggtgatttggtacttacactctcagaaccctttaggtcaagtccaggcaggggtggcatagacaccaaggtcttcctccttatgccactgtagcaatatctgatgcaagttaaagagcagccaacacatggcgatctccaagcccctcgagcaagttaagctgttccactccttgctctccacatcctaagtcttcctcccaggtcctccacccccaacctctctagtcaaggatacttggactggccccggccaccaagccttcgagctttgatgtcagggaagatctctctgatgatcttgccaaagttggctgtgctgagtgggcggcaacaggcaagactctcacagtacttcctgagtgagaggggagcagagtgggaagatactcagagaaggaggccatgggtaggctcgaagagtccctagggatcaagtgtgaggaaccctttaagaaggcaggctttatcaaggcaggaagctcttcatgggtgagggggtcctatgcccaccaatccactcatcccaccacccacccctccacccaccgataggcatcataaacactttgctttggcagacaggtgtcagtgtgctcttccaggtggttgcggatccacctataggcatacatgtactcctcattgctcagtgtacttggctctgagctacagaaacaaaaggaacaagcattactaagaccctaacagttgtcctggttcttcccaaactaccacttcagtagtgctggaccaaatttagttcacccagaatctaactttccctggtaaaccaagtcagggcgaggacctttcctcttcatcaaggacagcatttacgagtattcctattcacctcaccccttcccagtgaacctttctctaagaatcagaacctctgccatctaaaactactatcaaacctaccttttgtctccagtggtgggtcctgaggggagctgaaggtagagatacagcttgtcattgtcagaaaatttctgtacatcttgctgaggtaggagagaacagaggcaggagaaataataaggccaagaaggacccaatataggaccctctgatccccacaccaaagtctagctgacttacagggtgtcagactgaaaaaggaccttagaaattatttgacaaggccgggcacggtggctcacgcctacaatcccagcactttggaaggccaaggcaggctgatcacaaggtcaggagatcgagaccatcctggctaacatggtgaaaccccgtttctactaaaaatacaaaaaaaaattagctgggtgtggtgacgggcgcctgtagtcccagctacttgggaggctgaggcaggagaatggcgtgaacctgggaggcggagcttgcagtgagccgagattgcgccactgcactccagcctaggcgacagagtgagactccatctcaaaaaaaaaaaaaaaaaagaaagaaattatttgatgctaggtgctctgaggagccctataggctaccatggagaggagggaagtagaggggatcagctctgacttcatctctgctgggcttctatgcaagtgctcacagagatcaagtgagaggcacaaagtcaaactggcagcaagtttgcaaagccaactatcttctgacaaggcagaggaccctacctctcccacatcaatgttttgttgatgcccatcatcctcacatcctcctccctcagcatttccatccctctcttgccctcttccccaacacacttaccaggatcccctctactttgttctgcacggccttgctgtggggaagaggagaaagctggaggtcacacacaagattttccctgtctctttatctgactgctagggagggaaaaggactgaaatgcccagcaggtgctcaagaattgctaccatggccaaaaatctccctctgctcccatgcccttgctgagaggcagttcatctacagccaaagtgaagtgctgcagggatctatactcaggtcttggacaggacttggagatgtgatgagtacttacgaaatggtacctcggagcctctgaagaagggtggtaggttccccagcctcagcaccacctgggggggcccttcccccagtcttggggctcttagcatcaggctcatcttctgccatcccggcatgagggctagaattgagagggacaggcataaagatgtaactcacactggccttcccttccccagaaggccccagggcactcctcatctctttacccagaaaggcagagaaacagaaacaaagcctccgaatttccccggtggtctttttctcaccacttgccttctccgaaaattagaaattattccattacttcgccaggcccatatatgcccaaagagatctttgccatctccattctatctgccccacctttctgaagtctcctaaatctggaaaactgtaaaggaagagatagggggattgggaatccatgttagcaagaaattttcatttctgcctctgaccccatactgccctcctccccctcaaaaacaacaataacagccacaaaacaaagttctctaattctcaaaaatactcctcaccattgcatatgcctgggaggtcagaaaggatacgaacatattctgcccttctaggcttggaaaaaaaactgggcccaagttctcattacttaatctcgccacgacttcccccgctgctccccctccccacgtcgccggcccctacgtcatctcccacaacagcccatcctgaggcgcgcccccacctccttcccttccccctccattcaatccccggtttctgcaaagtggagcgggggtggggcggggtagcggaactcatgcgctgggcgtcagaaacccggcaggggaatggggtcccagattccgggcacgtgcacatgggtgaagaagctgttgaaaatacagctacaatctttttctgctctcctcccaactcatcttgcccctccctacctctgaacagtcgccttccaacacaagcaacaataaaggtaagggagaaagagaaactacctcgtagccaccttcactccagcccagccccaaggtcctggcccagccggctcgtgcgttgctttattttcctttttctgaat

SEQ ID NO: 1948 - DNA, 6654 bp, Homo sapiens; identical to SEQ ID NO: 1947

SEQ ID NO: 1949 - DNA, 9671 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaaggtgagcgggcgcaggcgtagtgaaattctcagagccctttaggccccgcccattccctccgagtcggtgaggaggggaaaagaaggcgcaggcgcaactgccctcccaggaccccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggaggtgagtggacctcctggatcgatttaggaggctcgggtgggactgggaccaatcgcacctttgttgagccgtcactcattatggggagcccctcccaacaaccatagcgaatatttattgagctccacgcttagcagatcccccgataagctatgtacagacataattcgttgtaggtctcatttccacattttgtcgtggaggaaactgaggctcaaaggttaagtcacgtgcccaagttctcacggcctataaattgagggattcgaacccagacagctgaccccagagccccggcttttttttcctttcttttttttttttttttttttttttgagacagagtcttgctctgtcgccccagctacagtgcagtggtgcgatctctgctcaccgcaacctccacctcccgagttcaagcaattctgcctcagcctcccgagtagctgggatcacaggcgcccgccaccgcgcttggctaatttttgtatttttagtacagatggggtttcaccatggtggccagcctggtctcgaactcctgacctcatgatccaccctcctcggcctcccaaagtgctgggattacagccgtgagccactgtgccctgccagagcccaggctcttaaacattgcacattgtaggtgctttggtggtggggaatggtagacctcgaaagcagttggactctggttttcatttccctggctctggtaattaacctggacctcagtttacccaccctcacagtgcaaggctaggtatgcagtcggtgcctactttattataactgttgataattattgtcatctctccccttctgacacctccgccagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggtaggatacctcctctgggattagccctctgggattccatgatgatggaatgtcaggcctcacatggaacctgtgtcttgctttcgtttttgttttgttttgttttgttgttttttgagatggagttttgctcttgttgcccatgctggagtgcaatggcgtgatctcagctcactgcaacctctgcctcctgggttcaactgattctcctgtctcagcctcctgagtagctgggattacaggcttccgccactacgcccagctaattttttgggtatttttagtagagacggggtttcaccatgttggccaggctggtcttgaactcctgacctcaggtgatccgcccacctcggcctcccaaagtgctgggattacaggcatgagccactgtgcccggcctgtttttgttttttgatacagggtctcgctctgttactaaggctggagtgcagtgatgcaatcatagttcactgcagcctcaacttcctgggctgaagccatcactcagcctccctaggagctgggactataggcatgcaaccacacctggctaattttttttttttttttgggaggctggtctccacctcctgggctcaagtgatctgcaggcctccacttccgaaagtgctgggattacaggtgtgagccacagtgcccggcccttcacacctgtttttaactctttgagggtagatagctaggagtgaaattactgggtcagatggtcatcctgttttacttactgaggaactgaggatttatttttgattggagtccaagaatatgcctaatttagttccctcccacgacctttgttgctgccactcctgtctggaatgctcttcctacacttcttcctatagctgactcccctcccctccctcccttcccgcctccgttttttttttctttctttctttctttttttgagatggagtctcgctctgtcgcccaggctggagtgcatggagtgcagtggcgcaatcttggctcactgcaagctccacctcccgtgttcacgccattctcctgcttcagcctcccgagtagctgggactacagtccgtttttttttttttttttaaatggaggtttgcttttgttgcccaggctccctcccctcccctcgcctcccctcccctcctttcccctctccccactctcgagacgcctcctggatcccctctcttcttgagacagaatcttgctctgttgtccagggtggagtgcagtggcactatcttgactcactgcaactccctctcctgggttaaggtgattctcctgcctcagcctcccaagtagctggcatgcaccaccacatccagctaatttttgtgtttttagtagagatggagttttgccatgttgcccaggctggtctcgaactcctgacctcaggtgattgcccgcctcggcctcccaaagtgctgggattacaggcgtgagccaccgcgcccagtccctgtagcggatttctttgacttcctaagatctcggtggtgtcaccttggggaggccctcctgttaccaccttgtctaagaaggacttattccttgtgctccgttcttttcatcctcttctacctgcttttaaatttttttttttttttttttttttgagatggagtctcactcttgttgcccaggctggagtgcagtggcgtgatctctctcactgcaacctccacctcctggattcaagcgattctcctgcctcagcctcccgagtagctgggattacaggcatctgccaccatgcatggctaattttgtgtttttagtagaggtggaatttcaccatgttagtcaggctggtctcaaactcctgacctcaggtgatccacccacctcagcctcccaaagtgctgggattacaggcatgagccactgtgcccggccttaagttcttttgaacacttatttcaacttgaagttttttattatttctctatgtctgatgcacctacttgacccccgactccctagagggcaaaaactatgtcttgtttgctcagaacattgccaggcagggaggagaaagatgcaccctgggtattcaagagagtagagtgagtgaatggtggagtcccaggcactgcctttggtagctccaagaccccagggagataccgaaggcagtagcatggtagctcatgcctgtaatcccagcactttgggaggccacggcaggagaattgcttgagcccaggagtttgagaccagcctgggcgacagagcaagactccatctctaccaatatatatatatttttaatttgctgggtatggtggcacctgtagtttcagctgctcaggaggctgaggtgggaggttggcttgagcccaggaggttgaggctgaagtgaactgtgatcacaccaccgcactccagcctggacaacagagcaagactctgtctcaaaaaaaaaaaaaaccccaatagctgggtgtggtggctcatgcctataatcccagcactttgggaggctgaggcaggtggatgatttgaggtcaggagtttgaaattagcctggccaacatagcgaaaccccgtctctacttaaaatacaaaaattagccaggtgtggtggtgggcgcctatgatcccagctactcgggaggctgaggcacaagaatcgcttgaacccaggaggcagaggttgcagtgagccgagatcacgccactgtactccagcctgggggacagacggagactccatctcaaacaacaacagcaacaaaaaaaaacagatgggcttctgtcctgaagcctcagagacatctactgaggggaaactgacgcctgttgtctgtttcccagcaggcagctccctgaagcactccaccactctcaccaaccggcagcgagggaacgaggtgtcagctctgccggccaccctagactgtgagtgggcccacggtccccaacaaggagaggagtaggagggtgggagggcctgtgaggagcaatcgtggacagagggtaaactgaggcacagagaagcaaggggatgagtgaggactctgcctctgtcctgccccagccctgtccatccaccagctcgcagcacagggggagctggaccagctgaaggagcatttgcggaaaggtgcgtgtccacacacatgtgctggcatgtctgcacctggctggtgtgtgcatatgggtgtccatacccactcatgacgtgacctgtgagtgtccacgtgtatgattgtatctaactgtgtgtgtgaccgtgttcatgtatgtccatcaacatacgctccccctcattcccctgtctaaccccagccccccacctcgtccccatttggcagcactggggatagggggcaggggtgcagcctggtggtattgcccgcctcctcctgccaggtgacaacctcgtcaacaagccagacgagcgcggcttcacccccctcatctgggcctccgcctttggagagattgagaccgttcgcttcctgctggagtgggtgcgtcccagcccagctgggcagctggggggttcccgggggccttagggtgggctggggttttggctgtgtctgctggcgccttgtctttgagatgcggctgctggctgggtgcagtggctcatgcctgtaatcccagcactttgggaggccgaggcgggtggatcacttgaggtcaggagttcaagaccagcccggccaacatgggtgaaaccctgtctctactaaaaaaatacaaaaattagccaggcgtcgtggtgggtgcctgtaatcccaggtactctggaggctgaggtgggagaactgtgtgaacctgggaggcggaggtagcagtgagccgagattgcgccactgcactccagcctgggcaacagagcaagactctatctccaaaaaaaaaaaaaaagatgcggctgctgtgggtaccccaggattcctggttatgccccaatccatcctaccactgtcccttcttctccctgcagggtgccgacccccacatcctggcaaaagagcgagagagcgccctgtcgctggccagcacaggcggctacacagacattgtggggctgctgctggagcgtgacgtggacatcaacatctatgattgggtgagggactgcccatccccaggacctctcagcctcctggccttcattcctgcctcaaatgttcacagagtacttgaaaggtgcaggcctgctctaggtgccgagaacacgagacagccccattcccagcctcacagagcagagctccccatgcagggaaggcagacatggaaacaggcagctgagatgcagtgaactgcgctgcgatggcagatgcacaggtggctacaagagccccatgtgggcaagggaaatcagagaggtcttcctggaggaaggtgtctaagcttgagaccccagaaagtgagatgggcccagtgatgagcaggaggaaccacgttcaactggaggccagagagtacaaggcattttgagaatgaggaagaggtaaacctttggtttctcctgcccctacccacgacagaatggagggacgccactgctgtacgctgtgcgcgggaaccacgtgaaatgcgttgaggccttgctgggtgagtgggagtcgggagtggccctgggggccccagcactccagcgggccctgcgggaatcctgagggcagggagacgcccaagtgttgcttgaagagttcttggagcaggtagtccctgcctgctcttctcggaggatggatcagaggggaggaggtggtaggaccacacgggagtcggggtctgggtttaggatctggccaagaggctaagcacctccatcctccatggttcagagacccttcagccacgttcttcagtggagaccaagatagcagaggttggacccttgtcaaaggccacatgggcaacgggcagacccacggctgcattgtggggaatgaggggtgccatgggatctcccaggtccccagaccccattctggactcccaggccccaccctccagcgccctcccctctcctttgcagcccgaggcgctgacctcaccaccgaagccgactctggctacaccccgatggaccttgccgtggccctgggataccggaaaggtcagcctgagacacacagagcaggggtggggtcccttccataggcagggtgaccataaaggggtacatgggacaccccttcagtggtcatacgccggcagcgagagtgtgttgacaggtgttgagcactgctgtgtatcccgcctgggaacatcccagtcctggctcctggggctccacatgtgctggggtagggaggacaatgggtgtcagtggctgtggccatgatgggggacacataggcatgagaggccgaaagaggggcctctcatcaaagagccccaaagtggccaacagaagtcagagaggcttcctggaggaaggtgtcttaaggttgagaccccgagaagtgaggtgggcccagccctgggatggggaggtcagggaaggattctgggggacctgaagggagggagaatggcatccaggtgggaggagtggcccctgcggaggcctggcagtgaggacaccaaggggtaggcgaccaggccatagtgcacagagccacagaggccatccctctccgtggcgggcagtgggtttgaacaggggccataggcagaccccagtttgactccattttctctgtcacaatgggaccccaacttccccatccataaaatggggagatcccaattgaaccgaccccctggggtcatggtagagatggggtgcttaggaaatatccccctccttccttcagagttttactgtgtttgggacagaaatcattcctcttccctcctcatgttttcggggggtttgtttttttgttcgaggcagaaagtcttgctctatcacccaggctggaatgaagtggtgcaggcacagcttactgcagcctcgatctcccaggctcaagtgatcctcccaccacagcctcccgagtagctgggaccacaggcattcgtcaccatgcctggctaattttttgttgttgctttttttttttttttttttggacatggagtctcgcgctgtcacccaggctggagtgcaatggcgccatctcggctcactgcaacttccacctcccaggttcaagcgattctcctgcctcagcctcctgagtagctgggaccacaggtgcacaccatgacgcccggctaatttttatatttttagtagagacggggtttcaccatgttggtcaggctggtcttgaactcctgaccttgtgatccgcctgtgttggcctcccaaagtgctgggattacaggtgtgagccaccacgcctggctgtgttgttgtttttttagaagagacagggtctcgctatgttgcccaggctggtctcaaactcctgggctcaagtgatccttcttccccagcctcctgagtagctgggactacaggcatgtaccactctacccagctaatttttaaaatcttttttatttattttttgagacagagtctcgctctgtcacccaggctggagtgcagtggcacaatctcggctcactgcaacctctgcctcccaggcaaacaattctcctgcctcagcctcctgaatagctgggattacaagtgcctgccaccacacctggctaatttttttttttttttttttttttttttgagatggagtttcgctcttgttgcccaggctggagtgctatggcgtgatctcggctcactgcaacttccgcctcccaggttcaagcaattctcctgcctcagcctcccaagtagctgggattacaggcatgcaccaccatgcccaactaattttttgcatttttagtagagtcagggtttctccatgttggtcaggtgatctcaaactcccgacctcaggtgatccacccgcctcagcttcccaaagtgctgggattacaggcatgagccaccacacccggctgcacctggctaatttttgtagttttagtagagatggggtttcatcatgttggtcaggctggcctttcctgacttcaagtgatccacctaccttggcctcccaaagtgctaggattacaggtgtgagccaccaagcccagcctaatttttaaatttttttggtagagacagcgttttgctctgttgcccaagctggcctcaaattcctgagctcaagcagtcctccccactggacctcccaaagtgctgggattataggtgtgagccaccatgcccaggctcatcttttcatgaaagtcacaattcacacattttgcttggtaggaaatatttttatattaattctgaaaagctacaaaagtgcatttttacaaacttaggggaagttgaggttcctggggtgagtcctcggttctcccagctttgctctgtaatgcaggtctctgcaagggtccctgtttgtcccctaaggggagagcgcaggttggcctgtgcctccaccccactcccgattcaagctcacagcccaccttttccctgccccatctcagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 1950 - DNA, 9671 bp, Homo sapiens; identical to SEQ ID NO: 1949

SEQ ID NO: 1951 - DNA, 10402 bp, Homo sapiens
cgcgcaggctgcggtcgcgcaggcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggtatcagacttagctgaggcctggggatgggaggtggaagaagaaacccgatcttaacgcaaaccgcatctgcagggcctgcctccccacttccaaatgggccggtttgcagtgactgggttagtggttgagaattagagtgtttgccctaaattaaagtttataccaacatgtgcaaagcaataacagttctgttgaactcatgataggtgcagaaatttcagtaaaaataatgtgacatcggcagagctgtcatagatctgggatatggctggaaggacatagagtaaatgatcggtctggttcatcgctaaaggagacttaggaacctagatgaagttggtacttctgagaaagtcatctctttctgttttcactactctattctcagtatccagttctcagtacccagttctcagtacctctatttgtaatactcctgtatttagtactttgtttttagtgtcctgttctgttaaccctcttcctagtaccgtatttttagtactgctatactcagttgcctgtctgtagtacccctgtacgtagtactcttttcttacaactctgttcccagtacccctatgtttagtcccttgttctcatgttctcactaccccaatacttaatatactttgttctcagtatccttgttgttagtaccctgttctcactaccccttttcttagtacccctgaggggggaaaaaaaggatgataatggggtataagtctcaaaaaacttttggattgtttgatttgaactgagtcaaaggtaaaaccagtgttctggagttcgacttctgggtgcaaatccctgttgcatcatttactggccttgtggcttgaataggttattaaactctgtaaaatgggcattaaaatcgtgtgtcattcatagtgttgctgtgaatatgtgagccattccatattgagggttcacacagtgtccagcaactggctaaagtttgcaaaccttacccattattattgtcattgttagtggtatactttgaggctgtcacaaataagcagatatttcttcttgtgagagctatataatcccttagtgtagagaaaaatttaattttgttacaagtgatccaagccaggtatggtggcaagtgcctgtatacccagctgtacttgggagggtgaagtgggaagattgcttgagaccaggggttcgaggctgccgtgagccttgtttgcatcactgcattccagcctggatgacatagcaagaccctgtctccttaaaaaaaaaaaaaaaaaaaaaaaaaaaattttttttaactgcaagctgtcttagggtcctaggatgtattctaagtctttaaatttcttagtttcaggctgaacttgaagtgctccatcactaaaatattagaccttgtaattgtttacaaatgtaatgttctaggccaggctcagtggctaatacctgtaagcccagaacttggggaggcctaggagggaggatcgcttgagcccggaagtttgagaccagcctgggtaacatagggagaccccatctcaacaaaaaaattttaaaaattagccaggtatgttggcacatgcctgtggtcctagctactcgggaggctgaggtggaaggatcattgagcccaggagattgaggctgcagtgagccatggttgtgctacttcactccagcctgggtgacagagcaagactttgtctcaaaaacaaaaagtataatattctaaatatttctaaaatttgcagttgccagtgtgtcatacttaattcacactggttaggactgagtgacttctctttcccttaagttttactcttttggagtaagaggacttctttgagggtctggtgacttaatgaagactcttcctagaaaaatccactatgtaactttaattttgcatactaattaatgggctcaggacttctgtaatcttagtttaaaaaccccctcaatccatattcttatagtatgttttaccaaatctctgattacggggatttagggaaataagcatctggaaaagaatgaaagttagtaaaggtgatcaagtttcttcctcagtatgttccacaggtgcccattcacttcagaattctttagagagggagaaaaataatactttttttctttcttttttttttttgagacagagtcttactctgtgtcgctcaggctggagtgcagtggtgcgatctcggcccactacaacctccacctcctgggttcaagcagttcttgtgcctcagcctcctgagtagctgggattacaggcatgcaccaccacgcccggctaatttttgtatttttagtagagacgcggttttgccatgttggccagtctggtctcgaactcctgatcctcccacctcagcctcctgaagtgctgggattacgggtgagacccaccacgccggcctaataatacttattttcaagaaagaagtagttaacctatggctgcttacttttttttttttaaactacctaacatttacatctacagtgaggaaaatgtataaaaggcagatagatactgaattagcgtctccctctgcacctcccacaaaaagaaccttattactattttgttatttatttacttatctaattttttagagatgggtctcacagtgttgcccaggctggcctcgaattcctgggctcaagtgatcctcctgcctcagccttcagagtaactgggattatttcaccactgcacctagcttcactattttaaaataatttgcatgactttttatggaagggaattaattgctataagcaacaaataatactaatagtttactatccagtttgtcttatattttgggatactttatcagttctgaggaggtaacaagatctgtaaatctttatctttgttaaactgagtgtaaagaaaataacagtgccagccaggatataataagagccaactgtatagtccggttttagtagttcagaggaggatagatcattgtaggctgagatactccagaaaggctttgcagaggaaacgtgactcagtataaaccagaaaggatgggcaatagtttacgcttaatgagctgagtttcttatgtgtcaagcactgtgttaagctataaatggagtctcacaacccttcagcaatgggatagatactatattttacatacatggaaactgaggcacagagaggctaaagaatttggcctaggtcatacagccagcaagtattgtactcaaacgcaagcagtcttattctagagctttcacttttacctccttactatactgcttccctagaattctggtagataaaaggaaagagaagcacattttagtaaagaaagagaagtaggaatacagaaaacacttttgtgaagatagcaagtggactattctagctaaaatagttgagtggaaaattcatgagagagaaatttggaaagataggttgaagccagttttttatagtattgaatgccaggctatgggatttggatttggagtctttaaatgaaatgatctaattaggaagtagcagaggatcctaccctgatggagtgggttaaagttgagagcctatagattttgagactctttcgaagattattatagtaggactgacaggtgatgatggtgtcttctgctatgttgtgagcagcaagattagaaattaagttctctattccaatgaagaatttattaaggtaaaaaaattaaagaaattaaggtatctaaaattaatatttcttacacaagtcaaggttaaatgaggaacaaatgtgtataatgtctactccaccaatctaagaactatgctatatgagagacacataaagggactagggataaatgaattgacctctgctggtgggattgttcttattaaatatctaaaaagctatcatttaagagaagcagtagacttatatggcatgattctgaggtaactaggactcttaggcataaatcacaaggagtatgtatttcagctcagcttaagtaaagctacctaacattctaccgaaatgttagagctattcaaaaccaaatgaaatgtggcaaaagttggtaaactctgtaggacaaaaagcattgcaggtttttgaaaaagaattccaacatctgtacaagtttggactagatgactaaaggttattttcactacaagcttctttatctaattcagtatctaatattttgtgaattaaccttttgaatttccatagtggggttgtgagggcagagggtactgtaccatcaagtcaatttcagcattccattatcttgcacataaaaatgaaagaatctcataaataaaatcaacttgggggttgctggaggaggaagaaattatttttgtttcctctgggtattagaattttctttttacagtttttatatgttgaggcctaaaatgtttaggggtgaaatatttttgtaatatcaggttggtaaacttctcataatgaaagaaattaaggggatattctcatagataactcagaggccagtagaaagaagcccaagagaaaaaacagcatagataatattctaagtaaagaacaaagaggttaaattcatgtaaggtatggctttccggtaaaacatttataattttatatttgctactttagtaagaattttggatgtggtattgtggcatagttttgtaagagtcagaatatttcagtcaactaaacaatattttgttatgccagcaaaattacaagtatttaagatgctgtcaggtaactgggggtacatatttggtaataagtgctgctgattttgtttttgggcagtgaaatctcagggtaatggtatcattttaggacttacctgttttgttcatacagttggcaggagactatttatactagtgctttttcaagcaagtttatctaaattttgaaagctttggttatcagttgcttctttaaacaatattttactactcccccatttgttttggttgccaactgggtaaaaagctatcagatatcttattgagcagtatataatttgcctctgagttcatatatttcatccaaaggcaagcagattatgtttcggcctggatagcattatataaagagaatggtcaattccacttggcattttttgtaatattgaaaatagctcacaagtaactctgcctcaatcttagtggcccacctctcacagtattactatatcacactctatcacacacactattaattttgagacctgccaagagactaaagaacccaggttgaaaatctggggggagagggagcgaggaggaatgttacattaaattaactgccaatactttgcctatgataatgaagaactttcccagagttgcccagagactgggcaagaagaaggaagaaatgcaaagacctgttcattacatctttgaaatacctgtaatcatgacttattacgttaactgtttatctatttgcatttttatcatttatcccaggaaagtgcagataacatactctccattgttaaacaaagaacaggatcttttggggatcgtcctgcaagacctactcttttagaacaagtgttaaatcaaaaaagactggtaaatatctgtttgtaaatcagttataaatgtgttaacaaacgtttgttataaatggaacaattgagatttttgagatttttagctcatgacatcacactatacatcaaaataaattcctaataagtcaaaattttaaaaaaagaatcggaactttacctcaaaaatgtaatgagattttttttagcttatatagacaaaatcacagagaaaagattataaacttgactacataaaaatgaatgctatagtcaaaaatggtggcaaattgcacaatgacctagagcaaaaatatgtacaacaaatataaaagactatggttaacgtgtctggtattttatcacataaaatattcctggttgggcattgtggttcatgcctgtaatcctagcactttgggaggccaggtgggaggatcacttgaggctgggaatttgagaccattctgggcaacgtagcgagaccccatctacaaaaaaatttaaaaattagccgagtgtgatggtatgtagctgtagtcctggctactcaagaggctgaaacaggaggattgcttgagtccaggaattcgaggctgcaatgagctatgatcataccactgtactccagcctaggcaacagagcaccctataaatcattaaacatgatcagtttccttacatatatataaaatatgtttgcctctttgacagcttcagtcttaactgcaaagaaagtttattacaaaaattcctgtaatttgatgaggaaaacctttggcttcaatacattgcaaaagatagaaacagaaaaaaaaggcagaataccattaaatgatatggaaaggtattcaatatcagtaaaaataaacaaaaagtgaaaattatttaaacgattacgcacaatgatgcagtgatgtggagactttcatgaaatggacattctcaagtagttaatggcattatatattggtatggcactttcagaaagcagttgggcaatatgtaccaggagtcatccctttcaactcagacatcacatttaatatgaagacatttacagaatgtaaatcctaaatatggatagagttaaacataaaggtattgccaggaatatatttctcataaatagtaaaaaaggtagttgaaacagcctaaatgtccaacagtgtcataacagctaagatgatttttaaataaaactgtttaataaatagaaaatgtactaagatataatacatataatctgaaagtcagtatttaatgatagtatgttcactttattcagtttatctttttgcagcttattggggccaaagatttttttctctataaatttatgtaagtattttattataaaaacctattacaggagactgtggcaggatgattgcttgagccgaggagttcaagactgcagtgagctatgctcacgccactgcactccagcgtggggaacagagtgagaccctgtctctaataataatatgttaatcatagtctgttatatttgttatattattacaactatattttaaagtgatgagtgtacaaaaaggtattggatgttttagagcagttatattttttcctgaaattttggtatataccgatatatatgtacatatatatatatacacacctatacacacaatttttaatttctttatgaagacttagttgcctaatgagaaacttgacttctagcactagtttgtatgtatgtacaaactggcatttagctgctattttcacatgtggccccctttcatctccattttttttcttgctataatcctgggtcagtgctacttttagctctttgttcttacatatttcaagagagtatatttgctggcatattagagaaggtgtttcctttttacacaaagtcaccaataacagacttcacccgttatttttaggttttagtattttgatgtgtgacatcacattatttttagtttgcagcttagttgcagtgcatccgatgtaaaagtgcttttgattcaggcatattcttgtgaacatattgtatcatatgtagggacacatcagagtaattagcatgaaaacagtctaatgacatagattaatgctattaataatttttttcttttctttctaagtcgttactaagaagtccagaagtagtgcaatttttacagaaacagcaacagctattaaatcagcaagttttggagcaaagacaacagcagtttccaggaacatcaatgtgagggaacttaccaagaacatctacatggttttttatcttattgtaatagatgagcatatttttttaccagacataaatggggtaataatctatgcctgtagaacataaacattttcctgtaaatgtatgtgtgcatttggggataagtaagtattgcactttgtgcatctaatctttcagattactgtgagtttgaagaagtcagcttatctttccaaataacatttaattataatgttttttaaaaaatatattcctcttcagtcattgttactgaaggtaatgaagcagttactttctgtggaagtcataaagttaatagatattaatcttgactcatctagctcagtggttctcatcaagggtcaatttgattgtcatagtgaccttgaaaaccactggcttttagtgagtggccaggaatgctaaatgttctgcagtgtcaggggtagtcccacatactaaagattgtctcacccgcagtgccaataacactcctaagaaatgttgatggctattttgtggtgctaacatgtagttggggcacctataattgggttctcttaataacctttctttgcagttaagactgaagctgtcaaagaggtaagcacattttatatagacgtaaggaaagtgattattgtttaatatctgtgaatttaggatgtgcatctcttttcagaggtgtgttagtaaaacctgacggattaactaagcacactgggatgtgtctcctacagttggcttctctctttgatgttacctgttagtgctgatctcttaaagcagacatttcttgtttgttgaatttgtgaacagtatagatctcagcccaccaatgccaagacaaaattatttttcttatacttattttttattaaacaaaatgaaaaagatccttttcaaaaaggtgatcctgaaaataaaactaacactccagtattttgtcattgtttttcgcaattgagctatctgaaaactgttattcctaagtaatgttcaaaaatgataagtaatctggatacctttttcttatactttctcctaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttgagttagctgatttctttattctgttctttagtttattcttactagatgcagaggaattcatctactgtctgttattaactgttagtttattctcatacttacgatgttgagagtttttttgaagcttaagttaccctttatggtggaaaacattagcttatgcttctttagatggaataatgggaaaggagggaaatgggaaatggatggaaatgggaaaggagggaaaataatagcccagtgagagctgaatgaaaagggactgaatttaaatatttgtaagaactttgtgatgatgagtaattgtcagacgtgggatagataactgagaggctcagaatctttaccaaggatattttttaggataaggtagctgcctgttcatgaatttggataagaatagtaggacaatattcaacacaatttaatttttgtctgccacattagacatttttttaccttataaaatgatcaataaagcaataaggtttattttgggt

SEQ ID NO: 1952 - DNA, 38364 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagtgagtagggagcaggggtgggtgggctaagttctgagcgggatggggacgttggctgttgtggagccgttggctgctgcggagccgttggtgggtagagtgagagggagcctgccaagatgtcagggtgacgatggctcttcggattgttattgtcgctgatgtggactctgagactgggtagtgaaggactctcacagctggtaagtaacagaagagacatgaacaagaaggaaatagagaaagacaaagagataagtgtggtggggggacaatgaaaaggaaacaggaggatgggtgaagacagacctattcactcgcttcacattttcagtgaggaccagccctaagtataaaaatgaaaaggcagttcattcctgagaggttctgagagccttccctttaaagcaaccagtagagtggtttcacctctctccctcctttgtcagagtggttttgagagaggctgttttttttttttttaatcgttctgtccagcacggtcttttttcaggttaccttgctgctgttcatgtacttttcattcattgattcattcattccttcattgatttacatttttggagcatgcactgccagttactgggcaggagtactgtgaggaagtgagaaaccgctctgccttctaacgcttctggcctgtgcctggaagagatcggtacagacccaagcatgaccccagcacgtgggagtgatgtgttggaggtgtgcaccaggctcttgaggcgctggctctgccagcctcagcatagcacctttcctgcccacaggcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgaggtagagagggcccctccgcacggggatccccagcgcttgggccctggctgtctgttatggctccccttggggtgtttgtttgcagctcgttagcatcaaatttgcaaattgcttggtagtttgaattttcttttcctttttttatagagacaaggtcttgctatgttgcccaggctgaactccaacacctggtctcaagtgatcctcccacctcagcctctcaagtagctgggattacaggctggatttcctgaagtcagtttctccttaaaacatctatgccttgattgggctccgtgggtcacttctgtaatctcagcacttttggcaggaggatcacttgagccttggtgctcaagaccagcctggataacacagtgaaatcccctctctacaaaaaataaaaggtgcatgtgaacagagcaagaccctgtctctgaaaaaaagagaaaatcttccttgccttttactgccctgagagtggtctcttcatcctctcgatcctgtggacagtcctccatagtctgtgtcttaggaatgtgattggctgtttaccatacctgtccgctgctctgcaatctacagttcagagacaagccctgtcttcatgatgcagacatcatctgatgtagagtatatgcatgatgggatgacattaaatatggattaatgaaaggatatacactataaatgaccgtgagagcagatagaatattagtggttgcactttgataccattcaacaaagttttattttaaattaaatatagaaattattggcaacaacactggataggatttaaaacaaaaataaaaattgtttaccaaagtcaaatgatttgaaaacatttttaaaagcttatgtgcctgttaagatgaaggccttgcgctagttgctcatgaatcaatagctaatatgacgtaggagagtaaaaggaggcagatagctaaataagtggtatggtgtgatggggttttttttttttcttttgtaagagaacaaggtctcactgtgttgcccaggctggagtgcagtggcacaatcatagtgcactgcaggcttgaactcctggccttaaatgatcctctcacctcagcctcctgagtagctgggactatgggcatgagccactgcacccagctgtgtggtggtatttttttttttagaggagtctcgctctgtcgcccaggctggagtgcaatggtgcaatctcggctcactgcaacctccacctccctggttcaagcaactctcctgcctcagcctcttgagtagctgggattacaggcgcctaccaccatgcctggctatttttttaatttttagtagagacaagttttcaccatgttggtcaggctggtctcgaactcctgacctcgtgatccgactgccttggcctcccgaagttctgggattacaggcatgagccaccgttcccagctgatggtgttttgatagacatactcattgctgagggagtacacatgagaggcacccactcagcctggaatagacagaaaaggcttccaatgtgaaggacatgtagacgttttgaagcagagaattagagaacaagtgttctaggcagagagaataccatgtagagactgccaaatttggggaactgtaaattcctgggtttggctagagcatagattgcacagggtatggggaggggtggcgggatatggctgcctttatggcaaatactcccacttttccactttcttctcccaccccacaattgccaagccaacagacatctcacaaaaatacccttgggaaggagaagaggtgatcacttatacgcatggtattatagtttgatcagattgctctccaccccagaactagagaagatcagctgtttgaagtaaacattttgattgggaaataagtctttggtctcccatccaagtactaaccaggcccaaccctgcttagcttctgagatgagagagaaatcattggggacatgaggcattgtgcaagatgagggaaagttcaggtgcacctgtttggactcagtcagggcatcaggaggacctgagagagaagcagaaagagaggagagagggggaccaactttgcttactcagaagtttttcctaagtccaaaggtataccaaggaagaagagaaaacatcttttctgctactttctgtatggtggtgatcaagctattaacagtgtagctctgctacgttatgtcataaatatggtttgagggggaatctcacttctatcattaaaatttttttcctgttaaccaacgaccaaaatacatatacatttttaggaaacatcttgtttgtatactgattttttattgttaagcaaaactgtaatttaaccactataatagaaactggaattgtttctgttagtattgatgctcacataacaagaatacaattataagaaccagtgacctgagactctacagaagcctgaagtatctgctaccaggtcatcaaatagatattaattcacttaagcgtagttttaacatcatgtttatctcagatttttctatgattgtaatcagtgtgaacatgttcccttgtattcttttttctcttaatgttattttacacgcgacatttgcatggcattgttcatgtccttaatgtaaacttagtatgatgtcgtgtgagtatcccacagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaaggtaaaccatcatcggtaggcttccagaaagttgggtgattttagttttaattctccaatgtaaatccattctcgtacattggagaagctaaaggaagacctagctcagcttataactgttgatgatggtgccgaaaggctctaccggtgattgagaggaaggctgcaggcttgatgggatcaggagataactgtcaggataactcatatcttttgggggaggagtggagttgaatggggtagatgagaagacctctttcctagactgtgttttttcctctgttagaaacatttagaaacattcaagggttgcccttttcatcctggaatgggccattggtgtcataatgttctccaggaaatctgtgtcaccaagactctcctcctctggaaatgcaggggaatgtgaaggtgtgtgcggaaaatccttagagttcagatatggcctaagagtgagatcagcggccgggtgcagtggcccacgcctgttatctcagcactttgggaggctgaggtgggcggatcacctgaggtcgggagttcgagaccagcctgaccaacatggagaaaccccatctctactgaaaatacaaaatcagccgggcgtggtggtgcatgcctgtaattccagctactcgggaggctggggcaggagaatcgcctgaaccggggaggtggaggttgtggtgagccgagattgtgccatcgcactccagcctgggcaacaagagcgaaactctgccttaaaaaaaaaaaaaaaaaaaaaaaaaaaaaaaaaaaaaaaaaaaaatcagcagtgcatcaaaaacctctactttgaaattttgttttatatttgtattcgattgtttacttctgtctgtattttaaaaatcagtttcctttgaacacattctttccattgtcgtaaagggaacaagggaaagggatttttcttttgttcattcaagggcaggatttagctagggggagtgtcatatctaattggcttctgcagcaggaatccaagcacaagaatccaaaaggggaagcggaaggggaagcagccctgggggaggcacccaggagctgctgacacaggggcctctcatcaccagcaggttctgcgtctagcgctttgtcctagtcttggacaaagggctgggaataaaaattccttattcataacctatcttcaaattcatgacttccctcttatgtcgtgggttagaatctgtgaattttaggtactcatgtgccacagttcatccccacatgcttgcttggattcctggaggcagaagtggaactggcacctatattctcttctgaactgtgctgccctgtcattttgccctgccagcactgttcttgttctgtgtctgaccttgctatttttctctctgcttttttgtctgtttttctcctcctttccaccctatctcctcttaggttcaggctacagctcaaaacaagcaacactgcagtccttatcctcagtgtgtctttgggatccttggacacttgcatccatgggcctctggacgccatttggggaaatagaaggtgtagtatttagccactgtctgctgcataaatgtgcagagaagaaaataaccattttccccccaagccctagaaatagttgaaaaacatacgcagagtcaatggggaatgagaataaatatgtttggttgttactgttcttgtcagaaacatcttccgcttttcccctcccccttactgcataaggaatacgataccagaatttcatgtgaacgtttcctgggcgacattttacaaatggctgaggagacacacagtttctatgagtctgttgagaagtcgctgttttgaacctgcccagtgcaaccatttctggaaaatttaccgtaccttatgtataatggataagcccaaaattgaaagtcagatctgatttgcttacggccttcaccaaacaatcccagtggctcaatgtctttcgcagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaagtaaggcattacttactttccactgccgtcccctcagcatctacacgcactgtgcctggaactaataggtgcccagtaaatttttgttgaatgaatgagtaatcccatttaggaatcagtgatcataggatgaataggaacctcgatagtgtgtcattagctggagaggtgctgtgaaattccagggttcttcctagacaggaaagttgattgtttctgcttgtgaggacttagcctttcacactacaaggcatacacttcatactttcactcattcacttgctccttcattcaagaattatttcttttcagtccctactgtgggcacttgagtcggcattgggaatataaagatgagtaagtcgtggcttgtgtaggatagagacactctgcagtttgttaagtgcataaactgatggatgttgtcctacatactcttcttgggtgatcatcagctcccatggtttgatgatcatctctttgcaaatgcttcttaaatctgtgtctctggctctggaatggatatccacttgtcttacagtcagatccatcgcaggtaccagaggaacctccaaagcagcatcccccaaacacatcctgtcgacactgtcctgcagctcgccccgcttcacccctcttcatatgcttgggaagtggcatcgccatccttttaccaagttgttgcccaataagaaacttcagagtcatcccagactcgcccttgcccctctctcccacattctatcagatctcaaaacctgtgaattcaagatatatgtatgactcaagatatatctgcaacccatctgcctttctctgtctccactggcctctgctcagttcaaaccctcctcgtttctgcagcaggctccttccaccgtccaccattcatgtggcagccaaaatggtcgtcctaaaaggcacatgcaaccctctccctcacatattggaaatccttcccagatgctctgtggtcttcaggatgaagttcgaattcctcagcgtggaataaaaggccttcatgttctggcctttgcttctctactggcctcgtccctaaccctcccttctttgtcagtgtgcagttacactgaggaatttgtgggatgcgtcatgatctctgtaacttctagtctgttgatatcctgcttctcttcctggagtcctcctccttaagtctccctttcccattctttacctgctaatttttctggactcaacaaagccttcctggacctttttagtcaggtttgtgctactggaaccccttgtacatccttttttttttttttttcccgtgagacagagtctcattctgtcgccaggttggagtgcagtggtgcagtctcggctcactgcagcctccacctcccaggttcaagcaattcttctgcctcagcctcccgagtagctgggactacaggtgcacaccaccatgcccagctaatttttatatttttagtagagacggggtttcaccatgttggccaggatggtcttgatctcttgacgtcatgatccgcctgtctcaacctcccaaagtgctgggattacaggtgtgatccaccatgcccagcctcagccttcttgaatagcaatgatcactctgtgttttaagtcactctcattaaactgagctcctaaagacaaggactgccctgtatttgcttttgcacatggagcatgccattggccttgcccacataatctttttgttccatcagcaggcagctttgtcgagaattttgttttatctgcagacattaagatattgtttggtcatctctgtagtggaatatgtcagctccttgtcataaggccattccactctatggaatgaggcagctgtaccagaggctgagaaaaatgagcagtattgttcaagttctgtcaccttcctgcctgagagaggagcaagacctgaaagaaagtctttgctttgtagatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggtaagagcatcttttctgactgtgtaggatgcatcctgtgtggtgattttcctagtaacatattgttaggaacttggtttgaatcctcagaaaactgagttcgacttgacttgtggttttaaactgattttctagatttcaaacatgttattcagtgcaaagaagccctctctctcaaaagcatgatggcacataaggccttcttgtttcctttttttgtaattaactttttaacttgggtttaaatatacgtaacatgaaatttaacattgtaactgttttcaagtgcactgttcaggggcagtaagtacagtcccatagtacattcactttccatcgtctctctccctgcccctggcagcccctatcctactttctgtctctgtgaatttaactgcactgggtgccttatatataagtggaatcatacagtatttgtccttttgtgtctggcttactccacttggcatgatgtcctcgaggttcatctgtgttgtagcatatgtcagaatttctttccttttcaaggctgaataatattccattgtatgaatggagtgcattttgtttatccattcgtccgtctatgggcacttaggtggctttgaccagccttcttgcttcttcacttcttttatttccatcccctcccttgtttagctggcatctttagaaagtattttgccgtctagattggccttgtcatacagggatgaggaaaggtgccgggatgtttgctgagcagtattctatggtgtggatgtaccacggtttggttaactactcactccttgaaagacttgtttccagttcttaactgttgggactaatgcagctgtaaatattcgtggacatgtttttgtgtgaatataagtcttcatttctctggagtaatacccaggggtacaatagctaggttgtatggtagtttcatgtacagtttattttaaaaattccctaacattttcccagaggggctgtgccattttatgttcggtgtccgagtgatgcaggttcttgtatcctcaccagcatggggtacccaggctcctcacacttctgcttagtcagctacaaatttatttgagtattcccacaagccccacttcaggtttggtaattcgttagaaagactcacataactcaagaaaacattttacttacgtctccccttttactgcagtgggtacaattcagaaacagccaaatggaagagatgtacaaggtgaggtatgggaggagggtgtatagaacttccatagcctttcaagacacaccgcattccagtgcttctgtgtgttcagcaacctcaagctctccaagcctcaccgtttaaggtgatttatggaagttccattacatacgcatgactgactaaatcatggtcattggtgcttgagcttaatctccagtccctctctcctcactggaagtcaaaggtggagctgaaagtcccaaccttctaattatagcttggtctttctggttgctagcccccattctgaagttgcctagttttctgaccccacccaaaagacactcttagaagactccaaggattttaggtgctacctgccatgaacaaaatcaaaccttcctgattctccaaggtgtcttcttttattgtttcctttctgtttagagaactttccttaatcattcttttaggatatgtctgaactctgtcattctaaaatttttttccttatagggaaggtgttatttttctcttgctgctttcaagactttgtctttatttttcagagatttagttgttatttatcttggtgtggattcctttgggtttattctgtttaggttttgctcagcttcttaaatctgtaggtttatgcctcttaaaccatatttggggagctttcagccattatttctgtaagtactttttaacccccaccctctttctcttttctttctggaattctgacaacataaaaactatatctttggttatggttatagtcccacaggtccctgaggctttgtgttttttttgttttttttgtttttgtttgtttttttcagttaattttctctctcttattcagactgggtaagttctatcattctgtcttccagttcactgatttttctgtttctcctcgattccacagttgaacctgtctactgagcttttttttttttttgacacggactctcactctgtcgcccaggttggagtgcagtggcgcaagctctgcctcctgggttcacgccattttcctgcctcagcctcccgagtagctgggactacagacacccgccaccacacctggctaattttttgtatttttagtagagacggggtttcaccgtgttagccaggatggtctccatctcctgaccttgtgatcagcccgcctcggcctcccaaagtgtgggattacaggtgtgagccactgtgtccggcctaccgagctttttattatgttttggtcattaaagttttcagctctaaaatttatattctccccttttttgctgagactttctatttttcatttgtttcaagcaggttcataactattaattgaatcgtttttatcatggctgttttaaaatccttgacaggtaattctgacattgctgtcatctcagtattggcatctattgattgtcttatttcattcagtttctgattcttaatgtaatgggtaatttttctgttgaaacttgtacattttcttcctatgtttggagattctgtatcctctttaagccttctgttttaactgaactttcctgacactgctctgacaagggaagagtggtggccaccttattagtgctgggtagaggtagaagttcagcctctcgactcagcccttattgacacctaaggtcagaggctcctcttcactgctgatcaggggtgggaattctggcagagtccacacggtccccactgacacagaggtgaaggtacctcattactactggacaatgttaaaagtcccgattctccactagacctcctctgacacttccccagtggggaagggaagggtggtcttgttactgccatgtggggcaaatccaggctattcttgtgttctcctgacaccatgggagtggaggcgctcattatcagctggcaggtaggacagccctggcttcctgttgggccttctctgacattaccccggtgggggtgttgggttacgttgttactgtctcatgcggttggatgttgaggctctccacttggccttagctgctgtgggtggggttggagccacagggttttttctgtggtggttggctggaacagagtggttgctgactaaaagttttctcctatccaagtactaaccagacctgaccctgcctaacttccaagatcagacaagtttgggcatattcaggatggcatggctgtagactggctaaaggttttctgtctgtcccttgctgccccttgcttagttctttggctagaaagagcaggctttagttggagatttttttttatctgtggctcttgatggtttgaggttgccaccttttcagccaagtctgagatatatgaggaaaagagaaaatccagtgaactcactatcgtgtgtttcatctgatcccgaggtttcctgctggtctgcctccttctcttctcctttcagagactctgtatgtttgttttataaataatatataggatgtttttgttgtacttagaaggaagattaagaaaaaagtatgtccactccatcttcctggaactggaagtttcttttttcttttaaggctaacagctgtaacccattacactaaatccttcctctgactatcccaatctctcataaatttgatgccagaggaacagaaacatggagttcgcccatccctgttcagctggagatgaactcacatcagggagcagtttgtgttgcagccagagaaactgcagcacgaataaaaagcacaaagagcacaggctattgaggcagaaacccctggtttcctgtgttagcctatcccttgttctgtctattaatcttattagtctctatcagagtcagtgatttggagcttaaatttttatttaagctttgcccacagattgaggtaagtaattcaaagataatagatggctaatatttttattttatgttagaaaataattaagaaatttaaagtacattttacttttacaggcattgaagaaaaatttaggcctttttatttaagtcaattagaagaaagtgtagaagaggacgtgaagagtttaaaggtaggcaatatagcagatgctcaaaatattaacatagcaaaatatatactgtcaatcatgaaaaccaaaacaaagtgatttgttattgagatttgaggtaagctagcttggtaaacatataaaacaaaatgagcaattgtctgcacatatcatcctgttggcatactggacccatttctccttcaaaactcatgaaatgagagaaaacatatatagcaatatgaaaacaaaagcacaatgtcactggcaaagattggaaagtaccataagtggatcagccattttgaggaattcttgaaagatagaaagaccacagaattattctgctgagacatataacagacaaggaatactagcccaagacataatgctgaggaagaagtaccggaggggcagtcttgggtcagtgtgcagaagcaacagcacagtcacctgggatgttgacaggggagtcatctgagaacctcatttatgctatttaggaaagtcggcttctctccctccttcccctgtacttagcaacagatggcagcagcatctgcccaagactgaagcaaggaggtggtttctggggttagaggggcatgacaaggcccagttaggaaccaatcaactaagaggaatggagaccaccccgcccccctgccaactctggaatcaagctactgccatccatcttccagcaacctaccccataatcatgaacaggagactacgacaaataaaacaggcagagactttaaaatataatttaaaaaagagattagaatcagctaagataaactctaaggcaaaaaatcattccctcaaacaatcaggaatatttcataatgataaaaggcccaattcatctggaaagtataaccgctttaaatgtggatccaccttcaataacatgacctcaaaatcaaccagccaaaagtgacagaactcaaagaaaaacagacaaatccacaattaaaactgaagattttaatacacatctctcttcaattgatagaacgagcaaacaaaaatcagtaaggatatagaagacagaaagaacatgacgaacacacttgacgtaacggaaacacaggatacgctgcacctaataaccgcagcgcacctacctgccgcacctagtaaccgcagagcgcctacctgccgcacctagtaaccgcagcgcacctacctgccgcacctagtaaccgcagagtacctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagcgcgcctacctgccgcacctagtaaccgcagagtacctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagagcgcctacctgccgcacctagtaaccgcagcgcgcctacctgccgcacctagtaaccgcagcgcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagagcgcctacctgccgcacctcggaaccgcagagcgcctacctgccgcacctcggaaccgcagagcgcctacctgccgcacctcggaaccgcagagcgcctacctgccgcacctcggaaccgcagagcgcctacctgccgcacctcggaaccgcagagcgcctacctgccgcacctcggaaccgcagagcgcctacctgccgcacctcggaaccgcagagcgcctacctgccgcacctcggaaccgcagcgcgcctacctgccgcacctcggaaccgcagcgcgcctacctgccgcacctcggaaccgcagcgcgcctacctgccgcacctcggaaccgcagcgcgcctacctgccgcacctcggaaccgcagcgcgcctacctgccgcacctagtaaccgcagcgcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagagcgcctacctgccgcacctcggaaccgcagagcgcctacctgccgcacctaggaaccgcagagcgcctacctgccgcacctaggaaccgcagagcgcctacctgccgcacctagtaaccgcagagcgcctacctgccgcacctaggaaccgcagagcgcctacctgccgcacctagtaaccgcagagcgcctacctgccgcacctaggaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagagcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaaccgcagcgcgcctacctgccgcacctagtaactgcagagcgcctacctgccgcacctagtaactgcagcgcgcctacctgccgcacctagtaactgcagcgcgcctacctgccgcacctagtaactgcagcgcgcctacctcctgcacctagtaactgcagagtacctacctgccgcacctagtaactgcagagtacctacctgccgcacctagtaactgtagcgtacctacctgctgcacctagtaactgcagagtacctacctgctgcacctagtaactgcagtgcacctacctttaaaggcttttcaagaacatacagagcattttcaaaaactgaccatgtgctgggaaatcaaataagtctcaatttaaaaggattgtaatcataaaaatgtcctctgagtatatttcaattatgttcaaaattaattttaaaaaggtaattggaaaatcttatgtggttagaagtaacgaaatatacttttaaatatcccttggatcaaaaaaaataaatcacaatggtatttagaaaatatttttcactgaaggctaacaaaacactacatattaaaattataaaatgcactttgcaaaggagtacttaatataaccttaaataaataaatatttcatatatatatatatatatatgaagaaaggctgaaaattaattagccaaacattatctgaagaagatagcaaataaacctagagaaaaaagaagtaaataataaggaaaagagcataaattaatgccgcagaaagtaactaacagcggatcaaaaaatccaaatattggttattcgaaaggctaatacaatagactaattaagactgatagagccaggtgtgaggtaatcccagttacttgggtggctggggtgagaggatcgtttgaggccaggagtttgagaccagcctaggccacacagtgagaccccatctctaaaaaaataaaataaaaaattaatgagacatggtggcatgtgccagtagtcccatgaaggctgagatgggaggactgcttgagcccaggagtttgaggctggagtaagctatgatcatgccgctgcactccaacctgggcaacagagtgagaccctacttctgagaaaaaaaagaaaaaaaagactgacaaaaaaggagacaagattgaaatccatgaataaggaggaatcactataggtcctgcagacatcaaatgttattaagagaatattatgaacaactttttgttaattattttaaaatttaggtaaaatggaccaatgtctttaaaaagttcaatttagcaaagctaactcaaatagagatagaaacttagaatattcctgtaactattaaaagaagcagtgataaaaaaagaaaacttcctatagagaaaaccccacagagagcttcatcaatgatttctgccaaatattcaatgaagaaattatgtcaatcttatacagttttctctagataatagagaagagagaactcttccagattcactttgtgtaagcataaccttgattcccaaaactggaaaataaggtacaagaaaggaaaattacagaccaatcttgtttaacagtatagatgcaaaagttctaaataaaatactataaacaaactcaattcatcaaagaacaaacgcaaaattcggtttctgccaagaatgcaaagttagtttaactttatgaaaatctgtcattataatttattacattgtcttcttaaatgagaaaaagatatatcttttcaatagatgcagataaatctgttgataaaatgtaatgtttattcatgattaaaaatgctagcaagtcagaaaagaaattccttttctgataataaggtatcttgaaacgaacagaagttttgtacttattttaacaaaatgttaacagccttttttttttttttttgaggcaaggtcttactctgttgcctaggctggagtgcagtggcgtgatcacggcttactgtatccttgacctcccaggccgaagcaatcctctcacctcagccccctgagggaccacaggcatgcaccaccatgcctggctaatttgtattttttgtagagacaggattttgccatgttgcccaggctggtctcaaactcatgagctcaagccatctgccctcttcagcttcccaaagtgctggaattacaaggcatgagccactgtgtccagcccacctttctctgaaataatatgcaagaccaagctacttaccacccctatttctggtcagcctggtactggaggccctagctattttagtagagcaagaaaaagaaagaagagatataggattggaaaagaagaaacaaaactgttcataggttataggatgtgtacatagaaaaactcaaaagtatcttttaaattaataatagtttagttataaaaatcaatatataaaaataaatcttacaaaaggtatgtagtaactctaaaagtataaccttaattgagagacataagaccaaagtaagtgaagaaatataccatttactttgtgattcggaagtcaccatagtacgaagatgtcagctcttctcaaattgatctatagaatcaatgcaatctcaaccaatatctcaagtttttttttttttttttttttttttttgagacagagtctcgctctgtctcccaggctggagtgcagtggcatgatctcggctcactgcaagctctgcctcctgggttcatacaattctcctgcctcagtctcctgagtagctgggactacaggcgcccaccaccacacccagcgaattttttttttttttaatagagacggtgtttcaccgtgtcagctaagatggtctcgatctcccgacctcgtgatctgcccgtctcagcctcccagagtgctgggattacaggtgtgaggcaccgtgcccagccaagtattttgttttgttttgttttgtttttgagacagagtcttgctctgttgcccacgctggagttcagaggcgcaatctcggctcactgaaacctctgcctcccgcgttcaagcaattctcctacctcagcctcccgagtagctgggattaaaagcgtgcgccaccatgcccggctaatttttgtatttttagtagacatggggtttcactatgttggccaggctggtctcaaactcctgacctcaaatggtccgcctgccttggcctcccaaagggctgggattacaggtgtgagccaccacgcccagcctatatctcaaccttttagttttgtgtgtgtgtggcaagtgggtgtgaggagtggaacttgacaaacctactctgaaatccatatgaaaaggtaaagaagagaataagatcagccaggatgcccttgaagaaggacaagactagtagtgaagggtttgccttatcagattcttgtcaagaattattataaagctatattaaaaagacagtggtattggtgtaggttggacagatactgttggaatggagttgaaaacccatagatctacacatacctagaaacttgattttcacagagatggcactgtagagcagtggggaagtgacagtcttttcagtaaatggtgctgagacaactgggtatccacatggtacagaaatgaaattgggcttctaccttacaccataccaaaaaatcagctccaggttgattactgacagaaatgtgaaagataaaattataaagctattggaaaatataggagaatttgtccatatcctcagggtaggggatcctcaacagtatacaaaagcattagctgtagtggtaagaactgataaattttaaaatttataaaattttaaatgaatgtttaaaacgaatttataaacgaattcattgtaaaattctataaattatttataaataaatttatacatttataaatttagaagatttttaaatgaatgtatacattcattttaaaacttttattcatcaaaataaaccattaagagaatggaggcagggcatggtggctcatgcctgtaatcccagcactttgggaggctgaggtgggaggatcgcttgaggccaggagtttgagactagcctgggcaacatagtgagacctcctctttacaaataataattaagaaattagctgggcgtggtggtgcccactttcggtcccagctactcaggaggctgagatgagatgactgcttgggcccaggaggctgcgccattgcgctccagcctgggttactgaatgagaccccatctccaataaataaataaataaataaaccagtcacagaatgggagaagtgcaacacacacataactgacaaaggacttgaatacataaaatctagagaaattgtataaatcggaaaggaaaagatatgcaacccagttaaaacagggatgaaatagctgaatgggcacttcaccaaagagaataaatacaccaaaaaagtgcacaactttactggtaattagagaaatgcaaattaaaaccacaataagataatatgtgtctaaacattggcaaatatggcaaggcttttctaaacaacatgaaataaatccaaataaacagtgaaatgtgtttatggatggaaagacttgacatactaaagctgtctattctccccaacatgatttataaaaggagtgcaatcctaattaaaagcacaaccaaattctttatggaattcaacaagctgactcttaagttacacaaaatgtacaaagatagctaagaaaattctgaaggaggagatcagaacagtgtagactacagcaaggataatcaaatagattaatagaaaaggtgagtctttgcaggttgggttttccagaagcagccactgagttggagattggggtgcaaggaaggagtgggaagcaggaatgagcagaggaagaagtcagaaggcaacgaagcctgacagctctggcagccgggagcactgagcaaatgcccctcaggcttgtcccacgtcagactgaaatggccaaggctttatcccctcgcctttctcagtcactggctcagaaggggagtacctggggcaaaggagttcacagctgcaggctgtttgttcactcagctccttgcaacagggcagcaaatccctccttgagggggaatctgagaggcccatcactgtgtctaccacaaagtccaaaatcaatccatgtatgtttcttaagccacacacaaaattcgcaaggtataaagaaaaagattattgtatatgacttcatgaaaatggaaaggtagtcaaaaaggagaaattgtgtttagcaaaggattaatatccaggatatttaatagagtgcctacaaataaaaaacaaaaataggccgggtgcggtggctgacgcctgtaatcccagcactttgggaggccgaggctggtggatcacgagatcaggagatcgagaccatcctggctaacatggtgaaaccccatctctactaaaaatacaaaaaattagccaggcgtggtggcaggcacctgcagtcccagctacttgggaggctgaggcaggagaatggtgtgaacccaggaggcggagcttgcagtgagccgagatggagccactgcactccagcctgggtgacaaagtgagactccgtctcaaaaaaacaaacaaaaaaaccaaaataaaagaaaaataatagacaaagaacatagacaattcaaaaaagaaactgaacaacatacttcagaaaagatatttggcctcgccaacagagaaaggcaaaatgaacccgttacaatttttcatccattagattgaaatttttgaaagattagtgatacagtgtgttggtgaaaatgcagaataacaagcagtcttctgcagtgttggtaagagtggcgaagtttattagaaggtgaggcacccaacaaactccacaagcccataagtttggctgcagttctactctcagtaatctatactgctcacgtgcactcaaagatgtagtttccattctttgcaccttagtttataagagtgaaaaattagaaacaactcaaatgtccataagtaactgccctaaattatgattcatctaaactacagaatactaatagccatttaaaagaaagaggtggaaactaacatgtaatgatatagaaagatcttcaagattagctgttagtgaaaaaaataagtcacaaaacaatacttacagtgtggtccttttaatgttaaagatatatatattttggcctggtgcagtggctcatgcctgtaattccagcactatgggaggcggagttgtacagatcacttgaggtgaggagttggagaccagctggccaacatggtaaaaccccgtctctactaataatacaaaaaaaactggccaggtatggtggtgcatgtccataatcccagctactcaggaggctgaggcatgagaattgcttgaacccgggaggtggaggttgcagtgagccaagattgtgccactacactccatcctgggcaacagagtgaaactgtgtctcaaatatatatatatttctggaatgtgtgtgcaaattcctagagagagaataagagtgatatgcatcacactctggataaggcttacctctagagaatggaagagtaggtgctgaaggaatgtttggatgttattctatgtgattctgcattgtttgaatctttgggggtttttttggttttctttttgagacggtcttactctgtcacccaggctggagtgcagtgacacaatctgggctcactacaacctccacctcccgggttcaagtgattctcgtgcctcagcctcccgagtagctgggattacaggcgtgtaccaccacacccagctaatttttttgtacttttagtagagatggggtttcaccatgttggccaggctggtcttgaactcctgacctcaagcgatctgctcgcctcggcctcctagagtgctgggattacaggcgtgagccaccatgtctggcctgtttgaatctttcaaaaggactttgtacttaacatatttgtgtaataaaaataactataaaaagaaaatcaatttgataaaattaaaataacaaaaatacttttcatattaggctaagcagggtggctcgtgcctgtaatctcagcactttgggaggctgaggtgggtggatttcttgaggccagttcaaaaccagcaacatggcaaaaaccgatctctacaaaaaacacaaaaattagccaagcgtggtggcgcatgcctgttgtcccagctacacaggaggctgaggtggcaggctctcttgagcctggaggttgagcctgcactctagcctggaggacacagtgagactctgtctcaagaaaaaaaacaacaaaaaacccttttcatgttaattaaaaacaataaacatacagctgggtgaggtggctcatgcctgtaatcccagctctttgggaggacaagctgggaggattgcttgagcccaggagttggaggtttcagtgagctatgaccatgccactgcactcctgcctgggcgacagaggcagatttgatctctaaaaataaacatgcaaagagacaaaaacaatatatagaatgctacaaagtgtgaacataattaataccctctgtcattctcccctagatcatgcatgtattcatttagctagtatttttgaccacttatttatatagcagacaatcgttaacagcaaaatacaaataaaactaggaaaaaaaaaacttgaaggaaaaataccaaagtgttaacattttatctttgggtgtagggcaaaactatggataggttttaagaatatataattttctatgttttctataatgaggattattgctcctataaggaaaaagttttttactgtggcaaaatatacttaacataaaattctctattttaaccatttttaagtgaacaatccagtggcattaagtacattcataatgttgtgcggccattaccactatctatatctagaacttttttatcatcccaaactgaaactctgtacctgctaaacggtaactccccattcctccctctcccagcccctggtagcttctattctgttttctgtctctgaattctaggtagctcctagcaaaaggatcacacaatgtatttcctttggagtctggcatatttcacttagcataatgttttcaaggttcatctgtttcatagcatgtatcagaatttcattcccttttatggctgaataacattccatcatatggatatacaggttgaacatccctaaacccaaaatccaaaattcaaaatcctccaaaatctgaaacgttttgagtgccagcatgatgccacaagtggaaaataccacacctgacacctctgctttctgatagttcagtatcctcaaactttgtttcatgcacaaaattattaaaatatggtataaagtgaccttcaggctatgtgtataaggtgcatatgaaacacaaataaacttcatgtttagacttaggtcctctccccacgatctgtcattctgtacatgcaaatattcccaaattggaaacaatccaaaatccaaaacacttctaatcccaagcattttggataagggatactacacctgcaccatattttgagttcctgccttcagttctttggggtatatatatccgggtgtggaattgctagatcatatggtaattctatgtataactttttgtttttctgagacagagtctccctctgttgcccaggctggaatgcagtggcaccatctcggctcactgcaacctccgcctcccgggttcaagcgattctcctgcctcaccttcccgagtagctgggattacaggcatacaccaccacgcccggctagttttttgtatttttagtagagatggggtggtttcaccatgttgtccaggctggtctcaaactcctaacctcaggtgatctgaggtcccaaagtgctgggattacaggcgtgagctcccatgcccggccatgtttaacttttaagtactgttaaaattgttttacatggtagctacaccattttatattccccaccagcaatgcacaaggattctaatttctccaccatcttaccaacactttttatttaccatttttatattatagtcactctaaggagtgtgaaagtgtacctcatggtggttttgacttgcatttccctatgactcatgatgttgagcatcttcatggcttattggccatttgtatatcttctatggagaaactgctattcaagttctttgcccatttttgaattgggttgtttgttttttgttgttgagttgtaggattttttttttttatgttctggatttcatccgttttcagatatatattgtttgcaactttttccccattattttattttatttatttattttttttttggagacagaatcttgctctgtcgccacccagactggagtgcagtggcagaatgttggttcactgcaacctctgcctcccaggttcaagagataactcctgcctcagcctcccgagtagctaggactacaggcacacaccatcatgcctggttagtttttgtatttttagtagagacaaggtttcaccatgttggcctggcaggtctcgaactcctgacctcatgggatccacctgccttggcctcccaaagtattttttccttattctgtaggttatctttttactcttttcatagtatcctttgatgcacagaagcttttaattctgatgtattatttttactctttacttttgtttgtgcttttgtgtcataaccaagaaatcgctgccaagtccaatgtcatgaagctttttccctgtgttttcttctaagaatttttgtggcactagcccttaaattaagtctttgatccattgtgagttaatttttatatggtatgaaataagggtccaacttcattatttcatatgtgtatattcagttttcccccatcgaatgctcttggcaaccttgtcaaaaatcaattggccatttataggagggtttattcctaggctttccattctgccccactggcatatgtgcctgtctttatgccagtcctacgctgttttgaatactgtagctttgtagtaagttttgaaatcaggaagtgtgagtcctacaaccttgttctttttaaagatcattttggctatttgggaaaaacattaattttaaaaaattactacttgtaagatctgtgtgaaatttctaccttctgaaaatatgaattcttctcgttaaaattttctgggactctatttcctgctgttcactaaagtgtgtatttatgctcttaattatagaaagagtattcaaacgaaaatgcagttgtgaagagaatgcagtctcttcaacttgattgtgtggcagtaccttcaagccggtcaaattcaggtaaattacactatggtcaaaatctattcatttatttgtttggttactcattcactccactctctaaaagactattcaggaccatatgggaaacagaagaaactataaaagtgaacacctgccttacaggaatttataataatattcgagagtcaagttacatgtatttgaaatatgaagtaacagtgtgctcaccagtcatagagtgttctgaacaaaaggcctaatatatctgatggggagaagtgacagttcagaagaaggaaggggacatatgtgagagcaaagtccctgaggagctcggagtgacttacagccagggtacaagcagagaggctggtctcaggtcaagtagggatacttttttcactgtaacaaaagggatggcagagtataggatactgaagccgcttagctacctgatctgtggctaattacttaacctcttctaaacttcactcatcaaatcataattgctcctcctctcatagggctcttcaagaatgaaagaattcatgggacatgcttaggacagagctgctgcagatcttttttttttggagacagagtctgtcaccccggctggagtgcagtagtgtgatcttggctcactacaacctccgcctttcaggttcaagcgattcttctgcctcagcctcccaagcagcagggattacaggcatgcaccaccatgcccggctaatttttgtattttcagtagagatggggtttcgccatgttggccaggctggtctcgaactcctgacctcaggtgatccgtccgcctcagcctcccaacgtgctaggattacaggcgtgagccaccgcacccagccacagatcttattttccacctgaattgctccaaggagacaaccaccttctctgctccaaaccaagtcccttttttccttgatcatccctgcaacagccgcttttctcttgcttgctataattttcctagtactctcttactgccagcgaggagctcctattattatttgtaaagcttgtgggaagaggaccatctcctaaatgctttggactggtctcgtacttgttttctgtgtgttactttgagatacagattcatgacggcgctcagattttattttactttttaatgtttcatgacacccattctaatgttgatcatttcttctcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacaggtaaatgggtcttcgatagtcacaagcttgtctttttttatttttcagaaaatacagcaaccaagcagctctattatagattgtgggttataatggggacagagggcatcatcagctgccagatgcaaattgcccctgtggaatggaccctgccaaaccacttggtctgggagtatttcatctggggctaggattcatcacagatgcccgcaagcatcgggttacaggtccttgtgactggcaggcatctttgactctaacctggagtgcatagtagtcctatttcacccaatctctgataaatgggaagttatctgcttatttgcttttaccttgcttgctactttttgaaggtaagaaatcagtcttggatatttttgtttctgaccttatatagctcaaagactaccattagtgatgaaaaattttcttttaactcccatatctctatcaggtgaagtaaaaggtaggtgatagtagttactggcagtctagaatggaagtgagttaatgtaatatccagcatttttatcaaataatactcaccaacatcaccttaactacctgaacagcatctaccaatgatacccacaggtgtcctggagatcttgaaatcatctcaggtagaggaagctttcagaaccacagagcttagttacattttctttcaaaaggccaaattctccaaaaacgtcctatgcaaacatcctcgatttcttccataggttttatgataagatctgtagaatgcaaaatattggattagacattaagcagtatccaagtcatgtataatcctatgagcagaatgtccttttgtttccttcatgttggggataaaattttttattagtattgccatatcattttattcattcatgattaagtcaataaaaatttcagctggggccatggttggccaggtgtggtggcttatgcctgtaatctcagcactttgggaggctgaggtgagtggatcacttgaggccaggagttcgagaccagcctggctaacatggtaaaaccctgtctctactaaataatacaaaaattagccaggcgtggtggcgcatgcctttagccccagctactagggaggctgaggcaggagaatcacttgaaccctggagacagacgttgcagtgagctgagatcatgccactgcactccagcctgggcaacagagtgagattgtgtctcgaaaaaaaaaaaaaaattccactggctgggcacagtggctcacgcctgtaattccagcactttgggaggccgaggtgggaagatcacgaggtcaggagattgagaccatcctggctaacacggtgaaaccccgtctctactaaaaatacaaaaaaaaaaaaaaaaaagctgggcatagtggcgtgcgcctgtaatcccagctacttgggagggtgaggcaggagaatcacttgaacccgggaggcagaggttgcagtaagccgagattgcaccactgcactccagcctgggtgacagagcgagactgtcgcaaaaaaaaaaaaaaaaaaaaaaaaattccaaaactcttcccactttgtgacgtgcagttctccaggcactggagctataactgaacaaacagcctgagtcccttccctcacacagtttaaatcctagtggacagaaggcagaccctaaaccaatatttaatgtgtcattttttatcttttttctacatgagcaacccaaatacacccgtttagtgccagaaatctctttgtgttttcacctcgttctggttcctggttctgccagtgacagatgtacagggatgcagcttcttcagggttctgagatgctttcagtgggaaaggggcgcttggatctacaatagataatagaattttctgtgtttctgctcccaaagatgatcctgccaggtactaagctagtaaatgaacacgctgagtttctccttgcaaatttaaataagtcttctgcttgcttttatcatcaaaaagtcctaactctataccaaaatatgagttttctaatttgccataccatagaagaagggtgtgtatgcagtaagtacaaaaggaaaataaatgtcttcctttcagtgaaagagctcttagacccactgctttttattcactgtgctgcttgaagtgaggttagaaaaggaaagctcactgggctaagagtcaggagacccaggtctagtcctgcttgtgccggtcactatatgggtgactttgggaaagtcatttgcctctccagagttcattctcctcaattataaatgaaaatgttacaactgaaaatttatatattatcagctctagtatgtttctagtattgcattcgtttctccacttcgtaactttcatggtttttccagtggtcagatttgggcagaaagcactgattcaagaacacagatttccaagtagagaggtgcagggtaaataaacctccatgtaagcccgcggtgagcgcagactgtgagtgacgaacacggtgtcagtgtaagctggaggtggtgggccaggaggattaaacagggtaaggcagcttaccactgtgcctggcgatgcgcagagtaagtgctcagtaaacggtagctgctgttattagcactgttattatcattgtcagcaaagaacacctagacagccttgagcactggaaggcacctcagagactgtcacaggggttccttgctaggattccaaggaccccagtttcagcagcttcacgaacaccctgaattgcacacagatggcgtgtgtgtgcacatcctatatttcttacacctttcagtagagagggtccctagtttccttggcttcctcagagaaaatgtaacaaatgagcacagtgcctggtccagagggtggcctaccttagggccaggtgtgctgacggaggtaccttgagctgatactcatttccctccctcctcagaactgtcttctcaaccaccttctctctcctacaaagatatgccaagtgctctttagggacagtaccaacacttgacaaattcagctcagcatgaatgtcattgagcccatgccccgtaccaaggcccaggctagcgagtgtaaggagtacaaaaacaagtgggtgtggtcgctgcccttgggactcacattctagtggagaagtcaaacagacccagctcagatacagagcggcgcagggcagagtgctgagtctaggattacagtgcaggctcatggaaggaggtggaatttgtgctgggcctatgtcagaaactcacaagcagggagaagcacgtggggaggtcagcagtccaggcagaggcaggagcatcatgtcagcagatcggtgggaaatctggtgggactggagtctctggagtggagacagggaggaaacagtgaaaggaagatcagagacaagagggtagggcagagctgtggctagcttctgaatactgaacctgagaggtttgagtttatcaggtaaaggaggaggacccttcacagatgctgttcagagtcgtgggatcccgctgggaagtgtggctgagctttgctgtgttgttcatccacttctgttttctgacttggtgttagccacatttttttatggtaaaattcaaaaacataaaatttaccatttcaaccatttttacagtggcattatctaacattcacagtgttatgcaaccatcaccaccatctatctatataactgttttaatcttgcaaaactaaaactctgtatccattaaacaccaactccccagctcccctcccagccccggacaaccaccattctactctctgtttctgtgactctgaccagtctaggtacctcatgtgagtggaaccatgcagcatttttctttgtggctggcttcattcacttaggaaatgtcctcaagcttcatgcatgttgtagcatgtgatgtgattcccttccttttcaaggctgactattccattgtgtagctagaccacagttgggttatccactcatctgctcatgggtgcctggcttacttccaccttttagctattgtgaataatgctgcagtgaacacgtgggtagaaatatttcttcaacaccctgttttagttcttttgggtatatactcagaaacggaattgctggatcatatggtaattctatctttaatttttttgaagaatcacgatttttttttttttttttttttgagacagactctcactctatcaccaggctggagtgcagtggcacgatcttggctcactctgcaagctccgcctcctgggttcaagtgattctcctgcctcagcctcctgagtagctgggattacaggcacccaccaccacgcctggctaatttttgtatttttagtagagaaggggtttcaccatgttggccaggctggtcttgaactcctgacctcaggtgatcacctgcatcagcctcccaaagtgctgggattacaggtgtgagccaccgcacctggcccactatactctttataggagcagctgcaccatttcacattcccaccagcagtgcacaagggcttcattttttccacatctttgtcaatatgtgttatttctttttttttttttaatcataggcatcctaatgggtatgaggtggtttagccagatttgaaagaagaaaagtttaaagggtggcataggataattaacttaatgtttggcataaagccctgcttttttgccatgctgtatttttttctcttgcttttgatctagaattacttacctgtgtgtttctctctatgcagatgaatctataaaatataccatatacaatagtactggcattcagattggagcctacaattatatggagattggtgggacgagttcatcactactagacagcacaaatacgaacttcaaagaagagccagctgctaagtaccaagctatctttggtaagataccctggaaggactcaacgcctagcaaccttgaactttcttacttgtgagaaggacatagtggaatcttaaaatttctctgataattcttcttgaaagttttcttatgttacttctgcaaaatatctttgtaatttccatataattcctttgtcatttatttatttttaatatggagataatcacagtatttaatttatggatttgttgtgaaaattaaatgagttgatatgtataaaaagcttagaacactgcctggcacatagtaagttctataaaaagtgttaaactttcatcatcatcatcatcagtattacttctcagacccagaagaaatagctgtgtcaggccctcatcgaaggagatcctgtaaaagatagaagactgtgccctccacagcacttctgtaataaaatcaagagggctatctcttatagggttctatggtgcagcccataatgctaatcccaaagtacagtctggaaaaagtcatgaggccaaaacgacttgattaagaactcagctttctaattaaccatgggattggcgctttttttttttttttctgtaaaggaaccaatagtaaatgttaggccctgctggctttgaggtctcttggaactactcacctctcttattgtagtgcaaaagcaaccacagacaatatgtacatgaatgagcacggctgtgttccaataaaagtggatttacaaatgctggcaggagtcagatttggcccacaggccatagttggccaacccctggtctaacccatttgaaggacagcttttaaaatacctagaacagaacttgcgaatggtcaggggcacctgtgagaatctaatgaaacccaggatctaccccctacagaaatattgacaaaatttggaaaatatcttgggaagttcttggactgctgacaatctataagatatggatagagagagagccacatcacagagggctgaggaaagaagagaggtgggaaggaagaatgaaatgttttcttccttatattctgtttaatgaggtagtgtggggattaaggaattttttttgttgtggttgttgtacattttcatttgtttccttttattatttttatgaagggcgaagggaaggaaccagtagaaggagagaggttatggctattggagaagaggcaatgtcggtcggcagtggggtggagtaaaggaggggttagggtccaaaaacagaccttgaagagtatagttacctcgtcgcttgaaagacaaggaaggctttgtaactgaatgggttcacgcctgctggacaattccttgattaagtaagaggaaagtgaactgttgggccggggtggtggtcaggagttgagcggctttaactctggccagatgtaagcggagaatgtctaaaaggaacaaaaatggtggttttccctttacacccaggaaggtctaataccaacaggatcactggctaagattgactagaacacccaacctcgtagccacacaggggttttgttcacagagccatcagctgtggctcagggatgtgtctactaggaggaaggaatgccttattcttttttgttttgtttttgagacaacatcctgctctgtggcccaggctgaagtacaggggcacagtcatggctcactgcagcctcgaactcctgagttcaagtgatcctcctgtctcagcctcctcagtaactgggactacaggcatgtgccaccatacccagctaattaaaaaaaattttttttttggtagagacaggttcttgctgtgttgcccaggactggtctagaactcccgggttcaagtgatcctcctgccttggcctcccaaagtgttgggattataggcatgagccaccacgccaggccgggaatgccctattctaattcacataaagactccatgtgggctagcaggcatgtgaaatgtctgccagtgcatcaacagctatataactaagaagttatctttttcactgtcttctggtactcttcatttcacttgggttttttagcaattcaggaagctggaatgtttgaatgggttttagcttgataccttcttctttttcccatttggcagataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 1953 - DNA, 4016 bp, Homo sapiens
tgactagcattccatcatgtttattgactcctgggggacaggtcacaaagtcagtttgtgggcaggccagactgccctagaaggaagtcaggggcctcaaggggtggcactcttccttaactcgtaactcttggaggcaagcttggaaggtgctttatttcccgctatgattataccaaccctgtggcctgctccaggcttcaggatctttagggccttcttgcgaacctactggtggggggtgctgcaagcccctccccttgcccgaaggtgccaagccccatgtgggcaaggcagttgtctgttgcatagtcaagtagttgttgtctccaacttgcaccccagagcagttgtatatgttaacgagcggtcgccctttaagagaaatagtgatggtggcaggagggtttagctgtcagaaaggccaagttgggggtgggtggggagtatgaagtctctacttgtcagtggctgtgtcaaggtgtgccctgtgctcctcccctcagagctcctctccagaattgtgttagcagaagctctagagagtggcaattgacatttgagaccctgatcttttttgctgggaggtcctctggactgctgaaacaatggaacttagggggctcacagagctggtgttgtggaaagttagaagattcagggacaaatccaagctttgttgtgtgacctcagagggctcctttctcagggggtgtcggttttcccatttatgaaatgagaaggttgagttagatcatcttctcccctcccctccacaaagtaccctgaatctagatataggtctggaggaggagtctggtggaagaattgaacagggaaaagaaagaggtagagaatgggtacctgttactggatttggctccggggtcctgcaggaccagttcatgccttgtctctcagccccctgcaaacagcacagagcatccagttctgccctggagcctggcactcccactgcactcctctcagccccaagttttcgctggcaaggggacagcatttataggactcttagtgcatcccctaatcctgtcaatgtctcacctgattccctcggggtccaggacttggtgttccagttgaggtagggctgggcatctggtttctgaaagttgaggtctctggagtctggggaggttgggccatcgaatctgaagatgtgcctgctgtccaggcttgtggaacctgctcctcttgtgccctgctcctcttggtaaggctcgggcattttttaggaacagagctgggaggctcctctagattcagtttgtttagccactcagaaaccatgacatcattacgagagtgctggttttctatggttctcctaaagccatccatttctgtccctccttggcctgactctgggatagaaaatctcctattgctgctcctgagctgagacaggaaatcctttacctgcagggatgggaggagtttgctgggtatgacttggatgagccagagtaaacccaagggagtagtctctcggtccataatctgttgtctgggaactcaggggtgggctggggacggtgggtacaaaggtcaaggcataaaaagcagtggtcagtggtgagtcattggatggccaggtagccacgctgtgccatccctgaccagctcctggggaggggtgatgttggcactcaccgtggagacagcagcattcatattgttctccaccatctggaagacttcatcagtttttggtaggcattctagagggacagcagagtggagtgcaggtgagcaaatcttcttttcctgagaaaagccccctgctgacagacccaagcttatcctagatccagctaactggccagctcaccctggaaggagggtctgtccttgggctcactgctccagcagagctgcattagctccttcagtccttctaagccgggagtctcaggcccggcttggggcagctcagccaatgaaggccggttctgcctgttgcacactgcttcgtacacgagtgatggttcggttggcactggagtaggggaggagggtgagaagagaaggcattcagggtaaaagggaattatctgcttcatcatggaaagaggcagggagtgtaatgtgggggcacgaggagggaggagggcagtctaagtaggtgagcgggaaggggaagccttggggctttcaagagaagggcacctggggttaaggatcccagaatcctcctagagtcttacactcaacttctcttccagcaagcactgcccacattaggatcccgaagctgcaggagacacaaagctgaggatcggtccaatcactggcaagactcctttcctatacatcatcccctgggagggcccagagaagtgtaggaatcctggctgtgtgtttgggccgggatccttacctgtagacgtcactggctgtggaggccttccggtttacgttaacaaacagttctggggccaagtagcccagggtgccccctggctccccggaccctgtccctgactgtgagcctccctgaaatgtggacaggccaaaatctgccagctgcaaaggaaggaaagaagtgggaggtagggaagacaagggggccagagagcctccaggaacccccctgcccccagaaggtgcaggttcagctttgtaaagggagtgtggaggtcaagggaagaggttcccttggatggtagatctaggtgccttgtggtagggctaggtcaaggtctgagtctccagggctgggtcagccatgactctttggaggggctggtggggcagctggtggaaatgactcgtgtggctcagggcctctatcacctggtaggcaggagctaaaactcctggctgggctttgtcccctggcagccctgtgtccagagagagaggctacgcctattcaatagacagggctctggaggtctagtgtccggcgggcctggctggagcagctctggggccttgtcttgaggctgagaggggtgtagaccagctgaccttgacgtgcagctctgggtccagcaggacgttggatggcttgaggtcccggtgcaggagcaccgggttctggtcgtgcaggtaaaacatcccaagcaccacttctttcagcaggcggcaaaggagcggccagggccgagggcactgggactgcagcagccccgacaaggagccgttctccatgaatttagtcaccagagccggcttgggatcttggtcccagttcaccttctcgataaccccttctaggcgcagcacgaattcgttatccagacttgccatggccttgacctccctggatatcgccttcctacactccaggagagagctggagtcgcaccggggtcgtgggaaaatccctcccttcgccattcaggccccagagcacagtggctccacctttttggccagattgcggctggggtcaaccggggtcactcacgagtttacgatcttgaccgccacatcgtagccccacttcctatgttgcgcccggaacactgtgccgaacccgcctttgccgacgagctcctggttctccagttcctcgatggacaccaagggggcgggggcaccgctgggcctgagagaggggtgtcgcccactagccggccgtgccgtgcctcagcgctgctccccgcgcccctgtgactcggcgttctcactgcaatccccagcctccctcgccggcccccaccgtccccggactcaaagacgttctctgagcgagtctgtggggctctctgggtgtgaatgtcggaggctgcgatcgacatgccactccctactcaccataacttgacgcacgacatcaggctggaaggtgccagggggcctctggaaattgcgagccgtaggagatggagtgacttctggggcttggtcctttcgcagagaggggaaggggtctgtctgtgcaggggtcagtctctagaccaagacggtgagtctactttccgggttgttaccctttttccgagttgactgaacaacttcccttataggcgcctctacagtcccgc

SEQ ID NO: 1954 - DNA, 268 bp, Homo sapiens
acagccgcgctgagaatgagccccgtgtggttggtgcgcggacacgcactgcctgcgtaactagagggagctgacggatgacgcccccgcgccacgccgctcagcgggatacgcttcttggcggactttggagtgggaagcggggaatgtctacgtgcgtatgcacgtggcactctctgcccgaggtccggggactttcccctaggcggaaaggggaggaacagagtcctcagtgtgtagcctaggatacaggccttcagcacgaacc

SEQ ID NO: 1955 - DNA, 7035 bp, Homo sapiens
gcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggtgcgcccctagggccagggaggggaggggcgtggtacggaggatgcgggaaacgggagtcgggattgcactgcaccaagggaggggatgtggtcgtggtgatggcacctaaagaagcagtgatgatagaacagggatgaatggcaactttcacgggctcagtgattggaccccggctgccagaaaactgacaccccttctccccaggccccatggtctacgccatctgttattgtcccctgcctcgcctggcagatctggaggcgctgaaagtggcaggtgagcccgaggtgtgcgtctggggaagggattcctgggtatgtgcaggggcaggtgagaactgaaaggggagggcaggaactgggagaaccagctgttccccttctcttccaaacctcctcccagactcaaagaccctattggagagcgagcgggaaaggctgtttgcgaaaatggaggacacggactttgtcggctgggcgctggatgtgctgtctccaaacctcatctctaccagcatgcttgggcggtgaggggtccccgggaggggcagccagcatgggctgaccaagctttgttcctagaatgagattaactgggctctgttccccaccacagggtcaaatacaacctgaactccctgtcacatgatacagccactgggcttatacagtatgcattggaccagggcgtgaacgtcacccaggtgagttaactgtaagttgtccccatttggtcatctcaggataaaatggggacaaaacaggagttcgagactgcagtgagccatgatcatgccacagcactccatcctgggtgacaaaggaagccccccaactcaaaaatggaggcagggcgcagtggctcacgcctataatcgcagcactttgggaagccgcggcgggtagatcaccggaggtcaagagttcgagaccagcctgaccaacatggtgaaaccccgtctctactaaaaatacaaaaattagctggacgtggtggcaggcgcctgtaatcctagctactcaggaggctgagacaggagaatcgcttgaacccaggaggcagaagttgcagtgagccaagattgtgccattgcactccaacccgggcaacagagcaagaccctgtctcaaaaaaataaaaaataaaaaataaactaaaaatgggagaccaggcgcagtggctcacggctgtaatcccagcgtttcaggaggctgaggcaggcagatcacctgaggtcaggagttgaagaccatcctggccaacatggtgaaacctcatctctactgaaaatacaaaaaattagcccagcatggtggcgggtgcctgtaatcccacctattggtgaggccgaggcagaagaattgctcgaacccgggaggcggaggttgcagtgaggtgagatcgcgccattgcactccagcctgggggacagagcgaaaaataaaaataaaaataaaataaaaaataaatgtgggcaaaaatgtgcagtgtgcagattcagcatcagatacgtctggagtgcctcgggcatattcattgctactgttgatttcgtgctcctgtttctgccctaaatgtgtgccacactgacgaccacagtgtagcccctagtcccgtctccatctaatctctccctcatcctaaaggctcagtctccagaacaaatcctacattgtctacctgtcacctctgtcctagcccaggacaccccccactccctggacacctgctgagtgtcgtctctcgtccctcaccctcctatcccctccaatctgttccccaagcagcaacagaaggtagtctttttgaaatgcacatctcgacatttagttttccgatcacagtggaaattaaatcaggaaaattcacagtcgagtggggcagaattacattaaattaccagagaaaaacataaatcagcattgcctcgaatgctctcaatgaaagaatggaccgttctgagagaataacaaggcaaaataaccttgacgtaggaattgtatgctgggtatggtggctcacgcctgtaatcccagcactttgggaagctgaggtgagcaaattggttgaggctaggagttccagaccagcctgggcaacatagcgagactccatctccacaaaaagaagaagaaagaaaggaattatagcaaggtagaccctgctgaggagggacctgaggaccaggcccaaatgcagagctggcgatacagtaactggtgtagacagacaagggccctacccgtaggcgttcagggcctagcctgggcagaaagatggtcagctggaggttgggcgcagtagctcacgcctgtaatcccagcactttgggaggccgaggcgggcggatcatcaggtcaggagttcgagaccagcctgaccaacatggtgaaaccccatctctactaaaaataaaaaataaaaaaataaaacatgaaagatggtcagctggtaaacaaaaaataaaggttgtttctgaaaacagtagtgctgtggagataccactttctcccagcagctcttggaccctctcttcggtgctgcagccaaaggcccccatgcatgggcccagcatcatgaacctggtcccagctcagggcctttgtactggctgttctcacacctagagccctcttccccagatctctgcacagttcacttcctcacctccttcaagcctttattcaccactacacctagctaactttttattttttgtagaaacagggtctccatatgttgcccaggttggtctcaaccacctgccctcaagcgatcctcccacttcggcttcctaaagtgttgggattacaggcttgtgctaacgcactctaccaatttttttctagtgttttctgccacctcagttcctagaacagtatgtggcatgcagtaggtgctaaataagttagagtaaaagcagcgtgatagagaaagcctcttcaggaggtgagttttttctttattttattgtatttattttatgtttttataaagatggggtctcactgtgttgccaagcctggcctcaaactcccaggatcaagcgatcctcccgcctcagcctcccaaagtgctgggatcacaggcctgaacaactttgcctggtctaggaggagatgttcgagttgaaatccctgattgatccatcctggggacgtgctggagaagaggattctgggtagcaggaagaacgtgccagggctgtgaggctagagcattggtacagttgtttgttcaattaatatgtgtctgttgctgtggcaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtcagtaccctactagccatggctggcttccaccatcccactatataggggccaggcatggccaccaaagggaaggagggagattccaggtgcctgttttgcccacaggtggcccgggaccaggccgtgaagaaatggcagttcgtggagaaactgcaggacttggatactgattatggctcaggctaccccaatggtgagcagacacgtgaccatggtactaatgttgaaatggccagggctgagcacacttctgaggttttctttttttcctttctgtcatttatcattttattttgcttattttttgtttttatttgttatttttgtttattttttgagacggagtttcgctctttttgcccaggctggagtgtaatggtgcgatctcggctcaccgcaacctccacctcctggcttcaagcgattctcctgcctcagcctcgcgagtagctgggattacaggcatgtgccaccacacccagctaattttgtgtttttagtagagactagttttctccatgttggtcaggctggtcttgaactcctgacctcaggtgatctgcctggctcagcctcccaaagtgctgggattacaggcatgagccaccgtgcccagcctattttttgtttttatagagatggggtcttgtcatgttgcccaggctggtctcaaattcctggagtcaagcagtcctcccaccttggtctttcaaagtgctgggattacagccatgagccaccacccctggccctttttttcttctttttttaaagagatggggtctccctatgttgcccagcctggtcttgaattcctgggcttaagtgatcctcctgccttggactcccaaatagctaggattacaggtgtgaactactgtgcctggctggaggttttctaaattgctctggtcaccctactccacagtgaaagaggccaagtgttagacagtggtgccatttgtttatggccacacagccagtgagtgatagagctgaattccaggccataggattgctgctgtcttccccgcttcccactttgctgtctttctggagccccagtgatggactgagacccaaggtgggcatttgtccctttgttaaggggaaggggaccaggcgtggtggctcatgcctgtaatcccagcactttgggaagctgaggtaggagaaccgcttgagtcctcgagttcaagaccagcctgggcaacatagcgagacccccatctctataaaaaatttaaaaaattagccggttatagtggtgcccacctgtagtcccagctactctggaggaggaggctaaggtgggtgggttgcttgagcccaggagttggaggctgcagtgagctatgattatgccactgcactccagccttggtgacaagatgagatcttgtgtcaaaaaaaaaaataatgttagccaggcgtggtggctcacacctgtaatcccaggactttgggaggctgaggcaggtggatcctttgaggtcaggagttctagaccagcctgaccaacgtggtgaaaccccatctctactaaaaatacaaaattagctggacgtggtggcacacgcccgtaatcccagcaactcgggaggctgaggcaggagaattacttaaacctgggaggtggaggttgcagtgagccgagatcgcataattgcactccagcctgggaaatgagcaaaattccatctcaaaataataataataataataataataatatttaatgacaggctgggccaggtggctcatgcccgtaatcctagcattttaagagacagaggcaggtagatcatgtgaactcaggaattcacaaccagcctgggcaatatgacaagaccccatctctacaaaaaatacaaaaattaggtgtggtggtgcgcacctgtagtcccagctacttgggaggctgaggtgagaggatggcttgagcctgggaggcagaggttgcattgagctgtgataatgtcactgcactccagcctgggtaatagagcgagaccctatctcaaaaaaataaaaaggctgggtgtggtgtttacacctgtaatcccagcactttgggaggctgaggtgggtggatcacctgaggtcaggagtttgagaccagcctgcctgtccaatatggtgaaaccccgtctctactaaaaatacaaaaattagccaggtatggtggtgggtggctgtagtcccagctacttgggaggctgaggcaggagaatcgcttgaacctgggaggcggaggttgcagtgagccgagatcgcaccattgcactacagcctgggtgacagagcaagactccatttcaaaaaataagtaaataaaataaaaatgtttaatgacttgttcttggaggtcaaggagatgtctcagaggcagtctccctgcactgcccttttagcagctcttggccaggtaaaggtcctgtggcaagaaggtgcttcagaccataggaggtgccccaggtactcaggaggaagccttagaagagcggcaaggaggccgggcgtggtggctcatgcctgtaatcccagcactttgggaggccgaggggggtagatcacgaggtcaagcaattgagaccatcctggccaacatggtgaaacctcgtcactactaaaaacacaaaatttagctgggcatggtggcatgcgcctgtagtcccagctacttgggaggctgaggcaggagaatcgcttgaatccgggaggtggaggttgcagtgagctgagatcgcgccactgcactccagcctggctacagagtgggactccatctcaaagaaaaaaaaaagagtggcagggagcttgaatgttatggtgcaacttggactgtcaccattgcccaccctaccccagatcccaagacaaaagcgtggttgaaggagcacgtggagcctgtgttcggcttcccccagtttgtccggttcagctggcgcacggcccagaccatcctggagaaagaggcggaagatgttatatggtgggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaattttattt

SEQ ID NO: 1956 - DNA, 60783 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgttagagtgtatgactgctttttaatgcaactttgcattcagtaggtttagtaataatattttcaatatactgagagaaactggattacaaaactgtgaggtaaattgttactttaaaaaggctttagtttttggtaaattttttttttttttttttgacacggagtctcgctgtcacccaggctggagtgcagtggcgcgatctcggctcactttttagaaaatagagaaaataataagaacttcaatctcccatttcttcattacccagagataatgtattgtcttataataatttttagaaaggaattacagttactttgtaaccttttttttttttcaacttttattttagactcagggggtacatatgcaggtttgttacagaaggatactgtgtgatgctgaggtttgggatgtaattgaacctgtcacccaggtagtgagcatagtacccaatgggtaatttttcaagccttgctctcccactcttcctccccttgaagtccccagtgtctattattgccatctttaagtccatttgtacccaatgtttagctcttacttataagtgagaacatgtggtatttggttttctggtttttttgcattaattcgctcaggataatggcctccagctgcatccattttgctgcaaaggacatgatttcattctcttttatggctgtgtagtattccatggtgtatatatgccatgttttctttatccattccactgttgatgggctcctgggttgatcccatatctttgctattgtaaggagtgctgtgatgaacatacaggtgcatgtatctttttggtagaataatttattttcctttgagtacatagccaatagtggccaatagtgggatttctggatcgaatggtagttctgtttttagttctttgagaattcttcaaactgctttccatagtggctgaactaatttacattctcaccaaaagtgttcccttttctctgcagccctgccaacatcatctgttatttttttacttttaaataatacctgctctgactggtaggagatggtatctcattgtggttttcatttgctttgctctgatgattagtgatgatgggcgttttttaatatgtttgtgatcacttgtatgtcttcttttgagaagtgtctgtttatgtcttttgcctaccttttaatggggttatttgtatcttattgatttgtgtaagttccttatagattctggatgttagtcttttgtcagttgcatagtttctctcactctaggttgtctgtttactctgttgatactttattttgctgtgcagaagctctttagtttaataaggcccccacttgtcaatttttatttttgttgcaattgcttttgagcacttagtcataaattgtttgccaaggctgatgttgagaagggtatttcctaggttttcttctaggatttttatagcttgaggtcttacagttaattctttaatccatctttagttaatttttgtatatggtgataggtaggagtccagttttattcctctgcatatggctggtcagttatcccagcatcatttattgaacagggagtcctttccccattgcttatttttgttgactttgttggagatcagatagctataggtgtgtggctttatttctgggttctctattctctttctttggcctatgtgtctgtttttgtatcagtactatattgtcttgattactgtagccttgtagtatagtttgcagttgggtaatgtgatacctctggctttgttctttttgcttaggattgctttggctatccaagcttttttttggttccatatgaattttagaatagttattttctaattctgtgaaaaatcacagtagttacctttttataaacattattttgttactattttcccagactactaactgttcttcataaatatgttttttaatgacagtataatttttgattatttggatatttgattatttaataaccatgatcctgtttggacatttggattattcacaaatgttcactatttgaagaatcagattataagtaaatatttgtccacatattttattgtttccttataatggatttttggatgtgggcttattggattttcaaatatatatttatgggaatatatttcatggaaagtttataagcttttgcactctaggcttattttaatggtcttgcactctaacaaacagtgggtgtgaaagcttaatgccaccttgttagcattggttgttacctttggaaataagtgtaaaaacattttattgtggttttaattcatatttccctgattagtagtgattttgaacattttttcatacttactaatcaattgtcatcttatagagaattgtcttttatattctttgctaaattattagagtatcaatatttttcttattgactaaaagtattctataacttaaggacattaattatttctactgtgtttgttgtaaatttcctttcttggtttatactttgcctttaattttgcctatgatttttgacatgcaggtgtttttagtttttatgtagacatatatacataaacttttcctttacacagatattgtacttagaaagatatttcattttacaggaaatttaaccagacacttttattttcttctgatttttttaatagttatgtttttggttcttttttgttttttttttagatggagtttcgctcttgttgcccaggctggagtacaatggcgtgatctcagctcaccacaacctccgccttcagggttcaagtgattctcctgcctcagcctcccgagtagctgagattacaggcatgtgccaccacgcccagctaattttgtatttttagtagagacggggtttctccatgttggtcaggctagtcttgaactcccaacctcaggtgatccatccgccttggcctcccaaagtgctgggattacaggcgtgagccaccacgcctggcctatttttgttttatatttaattacttaaatcatctagagaatgtgtaattatgtttaaatatgctgtgaggtaaagctgtaatttaattattttctcaccagtttagtttttcatttaatctgtaggattattttgtcaagttctaagagtaagttccaatgggatttttactgagattttgttagatgcataacttactttgggaaaacaaacatctttacaaacttaaatattcttatttgggaatatagtatttctttttagttactcaagtcttaagaatacctttcactaatgttcggttcttcatcttcaataggttctagacatatctttgtatgagtatgtgtagatattttcattgctattaatgaaatctgtttttttccagctaggtctaccaactggtcattttgtggtaaagttttatatttttatatatttatcttttaaataaccagtttactaaactattaatggaaaaattttccattttatttattttgggttttagtacataatatagtatgtaatttagtttttaaaaattgcatgcaattctttctaatagttacacctcttttattatatattttacattatattacatgggctagaatatccagaacagtattaaagagtaataatagccgtctttgtctaattggtgattttattgatgtgctttaccattaattctgacactagctgttgctaatatgataaagactatccatccttttatacttagtttccttaaggtttaaattaataattggtgttggttgttatcagaaagctttttggcatctattgaggtgtctataaagtttttactacttactatcaaactgtacccaaatgtctaataaactcaccctggcagtagataaaggatcaatagcataatggatacatcctatctttcttaacctttgtcaaatatagttttcaattagactttctacacttttattaaggaattttgcagacatattcataagcaatgctgctgttaggctttagcgttagaattaggctagctttccattttttccaatgttctggaaggattcattttgcattattatattctattgctggaaaatgtttaagaatcttagaggtaaaactatctagcactggagcctttttgttgttatagttttctttaatctgcaagagtttctcatctgttctttgtcttacttgacatttttgagtacagggtaaatatttgctggaatatttcttattctaatatttctttttgattaaattcaagtcatactcttagggcacctccaggagtaatatgtctttctcagtacaccatggcaggaatcacagtctatcccaatatcagtgttgttgactttgatcacttgattaaggtgctgcctacagttttcattgtgaattattgttgattatttttataattaataagtaatttgtgggtaagtattctgggactttgtaagtatcctatttcttatcggatgtttgcccactatttttaggatctgatgattttctaactttcatttcttctatatttatcagttggcattcttctgtaaggaagaactttcccttttccttgcttcttccctcatttatgaattcttaacagtatggatttatagatttttattttatccagtgggctatattgcattattattattaattttaatgctcatgttgtttcagaagagctagtgggagacccttcaagctgacttgtgtatcttttgggtatgtttctatcattctttaatacattcctgcttctgcgactggagtttcagcctcttgtcctgtgcaagccctgaatccacctttttttcaaagaaccctggttcctttcagtgaagaatggtatttagaaaccaagatctaggcagtaggtatgctcattgctattggtatgtcattgcttaggagccaaagctaggaaatgtgtgtgtgtgtacaacatgtacacacacatatatacactatatactcgtatcaacatttctaaatctatccatgtatctatcagtatttatctatgtgtgtggttttttgtagattccctttatcaggctgagaaagtttccttctgttcctagttcactgagagtttttatcatatataggtatttatcatatgtggatattgtcaaataatttgtatctactgagatgatcaagtagttttctttttaatagaggaatgtcttttaatatatgaattataatgattgatttttgaatgttaaactaattttgcattcttgagataatccctacttggtcacagtatattattctttttatatgtagtatggggtttttttcctaatattttgttaagtacttttttgtatctctgttcatgagggatattggtctgtggttttctttacttgtaatgattttgtctgattttgatgtcagagtaaaactgggcttataaaatgagttgggaagtattctttcatcacttattttctgaaagagtttgtgtgaggttggtgttgttgcttccttatatgtcggacacaattcaccagtgaagccatttggacctggaattttctttgggggaaacttttaaattactaattcaatttctataatagatgaagagctattctaattttctttttttttcttgtgccagttttggtaatttatgtctttcaagaaatgtatccatttgatctaggttgtcaaatttattggcataagttgttcatcacatttttattatccttttaatgtctgtggatctgtagtgatattccctttttcatacctgatgttggtcatctgtgtcttctttttgctttctctgttagtatagctaaaggtttgtcaatttcattgatcctttcaaagaatcattgtcttctggcttgcataatctctgatgagacatctatgatatttcttatatttcttctcctttacataatgtgtctcctcctcatgggttcttttaagattttcttctttattactagttttcagcaagttgactatgatgtgttgatgtggttttctttttgtttatctcatttgggagtgtattaagctccttgaacttttgagtttttaattttcatcaaatatggaaaatttctggccaatatttctttaaatacctttttccattctttcctcccttttctccctatcccctcagcttctggcctccaatttcatgtatgctggaacacttggtattgtcctccaggtcctatcactgagtttctgttttgttggttgtttgtttttttatgttccatttttagacagtttctaggtgtatcttcaagtttactttgatttatagcatttcatcttctgttaaccttagttatttaatttttactttaaatattgtaattttatttatttatttatttatttttgagatggagtttcgctcttgttgcccaggctggagtgcaatggcacaatctcagctcgctgcaacttccgcctcccgggttcaagtgattcacctgcctcagcctcccaagtagctgggattacagtcatgcgtcaccagacctggctaattttgtatttttagtagagatggggtttctccatgttggtcaggctggtcttgaactcccgacctcaggtgatccgcccacctcagcctcccaaagtgctgggattacaggcctgagccaccacgcccggccttaaatattgtaatttttagttctagacgttccatttggttcttctttatgtcttcccgtatctgttcttattatgcttgcagttttctttaaatacttcaatatagttaaaatagctacttaaatgtcctcatttgctagttctattatctttgttattttctatcttctaggtctatttttctcctctctcttttactttattttgaaataattttatacttttctagaaaagtcacaaaaatagtagagtttagatatgatgttcacccagcttccctcagtattagcatacatgaccatactacaaagatcaaaaccagaaaatttaccttattgtactttcacctatctttccactaatacttttttaatttcagaattcagtctgtgatggtacattgcatttagctgccacatctcttcagtgttttctaatttgtaagagtcccggccgggtgcgttggctcacgcctgtaatcccagcactttgggaggccagggcgggcagatcacctgaggtcaggagtttgagataagcctgaccaacatggagaaaccccatctctactaaaaatacaaaacattagccagacatggtggcacatgcctgtaatcccagctactcgggaggctgaggcaggagaatcacttgaacccaggaggtggaggttgcagtgagccgagatcacaccactgcactccagtctgggcagtaagaggaaactccatctcaaaataaaaaaaagagtccctcaatattcctttgtctttcaatgaccttgacacttttgagagtagtagccagtttttttataaatgccccttaatttttgagatactttgaaactatgttaatatcctatttcttttacgatcatttcactatactactaactaataatactgacaaacactgtatagcatttatgtgcttggcattgatctaagcactttacatataataactcatttaatccctacaaaaattataatcatagagtgccatacgagccagaatagtgacacccacccaaagctcaaaagatgagaggaggagctgcttaaacacttgcattattatccctgttgaaagttagcttcttcacaataggaactctgtaccattcaagcttgtgtcttgcacggtgccgagcacacagtatgcaattggtaaaggatgagtacatgatagtcagacaggttgaataatctcagcaatattctcactaattgagacttgattgttttttccagcaaagtcgagatctttatctacctttaaagtgcctaagctgttttctgggtttcttttgggtccttgaatatgccaagctgtttccacactggtgcctttgtatgactggtttgtctctatgtgcctttttctgaatcttcacaggactggctccatcttgttattatcacttatcttaatcacttttccagagacccaatccttgaccttcctcccctacccccacccagctcctactcagtactctccataccattttcctgccttactccctgcataggaccttgcctgactgcttcacatatagtcatgccccgcacagcaatggtttgattgatggcagactgcatatgcgatggtggtcccatgagactataacacagagctgaaaaattcctatcacctagtgagttgtagccatcataacgtaaggttgtagcacattgcattaccttttatatgtttaaataagtttagatatacaagtacttactattgttttacagttgcctacagtattcagtacactaacatgctatacaggtttgtaccccaggagcagtaggctgtaccatatagccaaggtgtgtagcagactacaccataggtctgtataagttgtataagtacactctgtgatgttcacacaacaacgaaattgcttagcaacacttttcccataacatatcccatcattaagcaacacatgactgtacatacacagcacctaacttggggttgcatacagtagaccttcaacagatgtttgttgcatgagagaattaaccaaccaaccaatccatcaatccatcctggacaccccagacaggtgttcagcaatacagtgttggagtccttgacagccttgtggctaaaccttgaacttcaagagtcgttctgagaatgagttttctgtgatgcattagtatttgaagtccaaggacttattcataaactcactcataaacttgtatgggccttaaatttgtgtgttaatgttgctggtaataaatgaaatagatacagtctttaatctctctggataaagggctgtgaattttcttctgtcagttgattgaactgcacttactggagtcattttacgtagcatttagagattatttatattaagcccgcaacctaaattattgcagtttgagaatatatgtggtttttataaactctttgtattcacagaggcttgaataggagctcatattatgatttagctacaaattatttgggaatttggtaaactggcaattttgttttcttgcctgtttcactttacctttgatgccaagttgaagatctcactggcaatgtacaacataactgagctgaataataattgaaaagtgaaaaacaaaaggtattacacataccaggtgccattttggggaataatattaggaataaatccatgtgggtttatagttatacataaaatgttcatatacacacataacacacataaacacacatatatacacataagtacacacaaacataaatgcatacccacatatggcacagatacagacttaaatctacatagcctgtcctttagaattctttaaggaatttcagactagagcctttttagactcttgtactaaacattaggatacgctagcctacttgaatcctttggccctttgcttctcttacttacatcatttttctctttgattaatgtgccaagtttgggaaagcttcacaacatttccacaaactgcaaaaccacttgggtacatagacaaaagcctccatctttttcatcaagccatatatttttttttttctgaaactgatcacaggttgccaacattcttttttatttctagtttatcttcaatttaaatttaccttgtagtctcagaccctgtcatctttcaaggtttgtgcttctcggttctgcactgccaaagagactctcctctgtaaggcttaaattggatgtcaagtggaattgtcttttgtttgttcgaatctgtttcatattgtgctgctgtccattcccaaaatcatatttctcttatttggggccttagcaagacacaaaggcaagctctaagtgagaacctaaagtgtacctgttttcttactaaatgtacagtgttgtttatattgtatgcaaacttctgacaacagtgaacaaatatcttaatctttaaaaatataaataaagtgaaaaaaggacttcacatcaaccatgtttcagtactaaacagactaattaatacaacatggcaggattgttcctggttgtagtctcagttccgccttaattctgtgagccatggaggaagtcattggcatctctggcccccagtcacttctcagcatgaaatgggactatatcatcaagattttttatgtctttccctccagccgctggtgcttggggagccatgtctcctttacacctgggaggaaagtgcttttagagttatctttcatgcagtgcttaccatgcactaggcactcccctaaactctttagatgaaccagctcatgtgttttgctggaagaaagtctggaagaaaatacaacaaaatgctcatactgggttttggggtgcccatgatatgtgtatatgtatatttcttttcttcatttttcaaagattatttcactttgccatagaaagaaatacaaagaacacaattgttggaaagtaataacaaagactggcaaagcgcattgtgatttttaaagcaactttgacatgaatttatgtgtttaatctttccaggagccatatggcacaaagggtattatttctcttgttttgcagttgaacaagggaaggtcagctcatttccccaacatcacacagctaatgagtaactgagccagaacttgaattcaggacctctcacatccagactctaccacatcaaattccctttccccagtggctctaactttgactctgttacatcctagaacatcacctctttaccagatatgaaagacaaccttttcacatagtttaggagttgactttctctgttcttaaagctgatctaacttgactagctgccttgtattacatattttctcccaaacacccctttctctaggacgaatccaaaatttggcaatcttgggagttagctatgtcatagtcagatctcttggaagacaaagagctccaggtctagagaagcaagtgggagggtgttttccaagtgtacttagaaaatgtttatgagctttgtcctcatctgaataatcagaagatatgatttgatttttacaccttggtatacacttggagattacacagtcctgaggtttatatattcctcagagccattagactgaccaaaagggttcgtccctgtgtttcatagtatttttacagttctcacagcaatcacttatcagtatttaaattgaccttagctgggcacagtcactcacttctgtaatcccagtactttgggaagctgaggccagaagtttaagtccagcctggacaacatagcaagactgtttctacaaaaaaaaaaataaaaaattagccaggtgtggtggcacacacctgtaattctagctacttgggaggctgaggagggagaattgcttgaggctaggaattcaaggttacagtggactatgattataacactccacttcagcttgggtgacagagcaagaccctgtctcttaaaaaagtaaaataaaataaattaatctttacaacaaccctccaaggtagaccagaaagaggtggtatccttattttattgatggtctgtgtgaggtcatacagacagtaggtggccaagcccagatgccaagcctaagcctcgttccttttgtttacccaaggttcctattcataccattatatgaccatttagccttaaataatctgttttaattgcaaattttattttaagaaaggaaaaaaatcacatttattctgctgcatcttcttgctttattcataatgaattctgcaggtcaatttatcctcaacgatggcaagccagaatttaagtaaagcttctacttagctggtacatttgcatgtcaaatctttaattcagctgtcagtgttttagcatttactgtactttcattaataaatgttattttgatggtctcaggctaatcaagactatttgaaatgggggacggcaccaaatgaaatttacagagaaatcagagcttcttcatggactttaaaataattgttactttacacgtgtttgaaatcagaatacttgtaaaattaaagttagacatgttgttcttgcataaacaagcaaaagaagctaaggaatcaacttagatttatttgttcctttaagagcatgtactgagcacctgctgtgtgctagacatgttgtagatagaggaaatgcggatatcaacatggcaggcaaaaataacctgccctcaagaatttccattctagagcgagtagacagatgatatctcagatagtgccagggcctatggaaaaagctgaccaggcagggcactgaattctggggagtgggtggtcagggaaggccttgcttccttctcatccacattctggcatagaagtttgatttccatgtacatgtttttttttgtaacatatagctccagaatacgttatttttaactttgcactcaataaaaaatcaacttgtagtaattaaacttgttcagtacattcttcacagggacattaggtgctactacttctatcagcaacaagtatatgcttatctattttttatacattggagtctacacaaggcttcctgctttttataaaaggaactgcctctacaaaaaaaaaaaaaaaagaaaaatggtttaagaattactcatctcagaacgttactttcgtgcatttcttgtattttattttttttcctataagatggtgcccatcctgtaagtttgggccaccccaacattatatttcactccctttgaacattcaaagaaaaacatacttcttggtgtgctctcgaggagcctgctatgaaccctagaatgagatctcggaggctggccacgatgggaaccccttcctgtgtctgaggtcatctcttagaagcgaaaatgctcagctgccctcaggactaaacccgccagccctgcgttctgttctaggagctgcagatggtgcttggggtttcaggtgactgtttctcctcaccaggacacaccacatgttttcctttcctctctagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttcctttttagaa

SEQ ID NO: 1957 - DNA, 47088 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcaggtaaacacgcgcgcccgggcggcggggtcggcccaagaactggcggagcggcccgcgaccccgggcgcgccgccccccaccccggtggctcccactacccggcccggcgcgggatgggattctctctgggacagctggccccgcattttggtcacacgtcatagcaagccgcggttttcaaacccggaagcgccgaaaaggaccgagcgtgtttcccgggccctgatccccggtggctcgggtgggagggtggaagccgactcagcctgaggggagccacgcgggttcgcggtcaccggtgcgctgcgggccccggaggtttctgcccttggtgtcccctacctggcagctggccctgcttctgtgatcctactgggttggaaccagggatccagtaggctcgaagtggcctcagacggtgcgcagttttaagaaagcaaagggacaggcctgcagtggcgaggcaggagggaagcgggatgggagtcgcggttaggccaagggtagttcaaagcgattcagcaggatgatgaccacaggagtgctggagccgggcctttcagcccccgtgtggatgatgaccggccatccaggacatgcgagggcttgggacagtggacagccagtgccacacaaggaaggaccgattaaatgacacagttaaaggaatttggcctagggagtgcaagccagaaaggtttggtctttttatatatgtaacattggaaaaaaggaacatctcctgttccctgtattaagttttgactttagctcagcaaatgcagtgtttgtggcagtaaatatactctgataacaatattctttcccaggaatttagagttttatgatggttattgaaaatgtttacatgacaggctgtcaataatattttttgcctctaaaaataaaacatacataaagtgtacggattttaagtatgcaactcactgaacttttcatacgtatacaccaccctagtaaccatcccccagttcaagatgtagactgtttccaataacgcctcatgcctgttcctagatagccccaggaacctctatgctgacctctgtcaccagagattagttttgcctgtttgaataagagtgtaccctttgtgtctggcttctttcactctgaaagattcatccttgttgtgaaattcattcatgttgtagcagttgtttggttggttggttagttttttcattgctgcttctgtttaattgtatgagtatccatactatgtatctctactgtggatggacatttgggttgtttccagtttgcaactattacaagttacacttctcagagcattcctttaggcggcttttggtagacatgggcactcatatctctagggtgtataccctggagtggaatggctggttctagtacttgtgtgtagagctgtagttgacaatgttaaatggttttccaaagtggttatactgatttatattcccacaagcagtgtatgagagttcccattgctgcacatcctcggtaaaaacgtttgggtggtaaaacagctaatgcaaaattcagggttttgacagaatctcgcaaagggctacccgtatacatgcttttcattagaaaaatcatcctttcttctcacttcgtcacatcaagacaattagattttcagagtaggaactctaatcattctttcagaatcaagtgcattattgttatttcagatatacacaatagctgatgataatttgagcttcttattttgttgttctgtttaatcagtattgacatcgtcattttatacgtgtgtttgtgtccttgtattaaacacaaaaccctcaaaagaattaaatattgattgtatccctgaaaattgtaggttttaatatatctactgctgggttgtgggaagagtttcagttgagtttctgttcagagctgagatctactgtgaccttttaaggcattgggggaggctgagcagctgttggaactgctagaaagagctgtgtggtcaggggggcaggaactcttaacagttaaaaacttgagctaccagctcctgcaattcttccttctggcctttagcgccacctgcaggctctgagggtacaacaaggtttgacagcgactgcagtgcaacactagttctcaaacttgagggcatcatttacctggggagctgggcctcagttcccagaggtgctggttcagtaggtcctgggctggggccagagaatgtgcattggtaacaagttcccaagagatactgatgctgctggtccggaaaccactgcccccaccccaggaaccactgcagtaaagactttgggaactagattgggatataagaatgacaagcctcatgtttggccctctttgtggtgggccagaatttatatggtcaaggaagtgcatgtaagtgcagagtgtgaggctcatcttcccagatgtagttgtcgtcttttccagaagatgagaaatcagcctgcttagttacccattcgggagttggaaacgatatgcccttggctgagggagcaccatactccagtaaagctgggcccttaataaagaaaacaaagattattaaacatttttcaaaagtatttggcggaggcggcttgtattcggttttagaaaacttgggatctgaagaacttactttgtgtactgaaaagtgagcacatgaacccacaggccaacagaactttaaagggatttatccgtgagacaagggtaaagatgcctaaccttgcaatgatacttttttccaacatttaattcatgctgttcatcgagttgcctgccacagcactgtgttatatcttgaaggatatatttaaatgtttgatttaggtatctttgcctctagttttcagtttgtttggagaagctggctatctcagataaacaaatctggaacttggaagagatactgtgagatatgcagacttgggacgttggttttcataggctggtgaagacagaaccatttcccatttcagcaaggcaagcatttcttttagtttgggatggtcttaaatgtttctgtaaaatggcctgggaatactagcctgtttgcagttttaatttctataagaggccattactttactttttggaaagtagtataagtttccatccctctttttctgccctaaaagtaaatgtttgagtcatatttttaatgtttttcttaagtccatttttcttgttaatgctactaagttgggatgtacccaggtgtgagaggtcacctgattcattgcgtttagaagactgcatttattgctgttgggggctgaacaattaattgggttcatctccaaggaaatgttaattgggaaaccctaacattgtgtattgaaaaaaaaaaaaagaagaaaaatcatttcaggcctgttaaaacaaaactcatttgggttcacttaggctgattaaaatattccttaatcagccccctgattaaacagtcctgaggtgaaactgcacctcaactcgaattttcagttagagacaagttttgcaataaagttatccccctttatttcatgaatatacatgttaaaaagtattttaggaaagattgcacttattatttatttctccacagaaagcagtttcatggaggtagaggatgggttgctttttgggagataagaatccctgtctaccttagacatttcaaatacaataacagctttttatgtgaggcatcgtgataatcacaaatgattataccagagctatctttccaattggaatgcaaaaatagatgtggaaggattgtataaattcatgcattagaactatgttctaattaaaggatttaaaaaataaatttaaaaggaaaaactaattttcttatttaatgatggagaaaatttatattaatgttatttctgattacagtcttgaagattttttttttttttttttggtccaccaactggcataattgtagctttttataagtccaaagaaatgcctcttgttttgggggaggaaaaaaagtaaaggtttaaagtgtatggcaaaggaagaactactatagatttaactgacttttcagtgacactaaaaaacactcttttcccttctttacctaatggctcatggttaatctcagaagaaaaagttaagcaggatttttgttctttgtcaaaacggtatgtatgtatatgtttgtgtttagaaatatacgtgagggccgaaagcttccttattttcagaagagatgaacttcacttggcacatgatagagaacctggccaattcaagtgctgattttagacaacctcggaataattaagctcagctttttggaagatgtgtcatttaccgaatagtctactgcaggcagtcagcagtgtaggagtctcagagttttccagcatagagcgtgtttaacattttccacatgaatctcagtctggctttgtttttgcaaaatgtttttcggtgggacccgactgacctttctcagatggccactggatctgctccccttgctatctatctgagcacgttctgaagtggatggacttcagttgccagttggtgtaatcaggctgtttccagagtctgatcttgtccctttagtaactgttccaaaatacttgggacatttataagtaagaactcatgactcccacatatttatcctccaggtcagaaaaaaattcataaaaggaaagcaagcagtgttcatgattttttatttgagtaacagaatagggactgcatggattctcccacatcctctgagactgtgattttaaaaaacaaacaactcagtcagtgtgctccaaagcctggctataataacacagacttaaaagctagatttatgctatttattagctctgtgtcattgggtggtttacttcctcactataaagcctcacttttgtcatctccacagtggggagaagagtaccagtctcatggggttgttatctgtggtttgagttactcataagctttcttacacctcaagcttttagccctgggcctgggacagagtagatatttcaataaatatttactgaacgaataaaagtctcacattccatttcttcctgcaatgtctttgcttattctgctttttcctccccttctacttctatccaaattctaccctttcctcaaggttccattcaactttattttccacaaagctaagccatttgctccagctcagcttctccgtcttgactttgtgtctgcctggaatcctgcctgctcttcactttatctacctggcaaattcctacttatcctttaaacccagctcaagtatcacctctaccaggaagccttcccatgggtctctcctcttgttactgcccaggttcgtggtacctctttgaccacctacacatttcatcatgattattcatttaagtgccatttttatataaatatgtattgaacacctaatacatgccaggagctagagagagtccaagtgtgttttccctgagtggccatttcgcttctcagtgtgggcacctcagccttctgcttcagagcacaacctccaaacagtagagcatgtcacgtaggatttccaggcctttattcagagctacctttatgacttccttgtctaaggatgactgtttgctaaagcagaatgggccaccccgtggcaaggggatgtaagggatttggggctgcatgttctagtccctgtttcattatctgtccccgaaacagctaagctggaggctggcttactcctccgagggcctaggtctcaacatttggtaaggctctcctgcatgattggctacctttgcctgattgtttttaaagattttttgttattgttgttgccttttaaccttcttttgaccagttaactctacatttacacgtttttctcacagtggtttttttttttgataactttaaataattagaataataatatttacccagtatagaaattctagtaatatggggaaaaaaataaagaataaaataatttgtccatcatcctcacccaaaataaaaattttggagatatttctttccagttttttcatgttgtttacattacaaaatgaattccaatcttcttaaatttttttttcttatttttctatttttgcctttatttcattgtttacccttactacttatttaatgtaacactaaaacactcagggagattggggttacataaaagtttatatggtgctgttctacataaaattggagaaagttcagttgatttaatagaggtaggggctgtttttttcctcttaattttgataaggacagaaactcacacagtgatatgaaacaagttgacaaagagaatttgtattttaggctttgaacattgaagaggtgtaatacttattgcttcagacagtagacagtacatatttggaatgggttatctttgaaagtggataaagattgaaaatacaaataggtgcaaaagaggtaaagatacatttacagagctgtattggacccaatggcaaactaggatgtttcaaaagccattcaaagcaggttacatttttgaggacaaccatagcctcctgcaaacatcccttggtgtgctttcctgaaaccggatactggtttgaatagcctgtgagtctgccttagtatggaaattgccattttttaatgtggggtcagtgcacctgggttgtgtgttacaaaatcaaacatgaacttctttgggagttccttagcaggttcacatcctcccaggaaggagcaggggtggtggagagcataggacatctggccctagggtgttgcagcagcaggagtccagggtttctgcctctctgagtgttaacttcctcttctcaaactaacttcctgcatttagtgaaaaactggtttcacgtgattcccaagctgcagatccccccagtgtctgctgggaggggtctctcctcttagttccagtttgaaacctttcaaaacagccttctgactggtcctgctgtggtcacatgcagtcccaccctccaccacctattgtagccagggaggggcaggctgtaagcacaaggtgggagaggaggaggacaaagtgggcacttgaggctaaagagtgcttttctggaagaaggaaagggtacaggatagacagcagaggaactagctaccacgtcgtttcaccagtgggactctgagctctggccagaaacctcagccactcatgagctgtcttgcctatggccaacattaggggtttctcagttgctggtagtctgtttgactggcttgtatataggtatagcagaggtttatttgtatggagaattgggttctagttgtaacttgtacttgccttcatttagtcaaagtttgtataatttttaggaagcccagcttctaggcctgcaacttctagctgttataactttgcaaaacactttcatataattgtatttgaccctcttgatgaccttgggaagcagttaaggcaggctttattatcaccattttgcatatcaggaaaccaagactcagagaagtcaagtaatctgtcaacatacaatagaaatccagtggcagagactgtcagctctctcaagtccttttccaggactcctgcatgtgccagaggccactctgctgactgaataatgatgcctcaccactgtgggagaggccagaggaccaggaaaggctggtctcaaactgctctcagtttgatgactagggaccagacatacctccttccctggaaccaaacctggttgctctcagtcaccccaatcaggtctgtcttttctagcactccacaatttttcctgcttcccacatagttcatgctccatccatgctccatctcagtatgtttgctggtctttgtggctctgagttggctgtgaacctgaatatttttactagcttcttcaccagtgcacaggctgttcctagaaacatggttgttgatagggacagccctgaaagaatggagattttgtcttctatggtcctgctgaaggctagtttctaatttttatatttatttatttatttatttagagacagagtctcactctgtcgcccaggctggagtgcagtggcacgatctcggctcactgcaagctccgcctcccaggttcacgccattctcctgcctcagcctcccgagtagctgggactacaggcacccgccaccatgcccagctaattttttgtatttttagtagacacggggtttcactgtgttaaccaggatggtctcgatctcctgacgtcgtgatccgcccgcctcggcctcccaaagtgttgggattacaggcgtgagccactgcgcccggcctctaatttttatttttttctccaaagcttcaaaagaaagttacacttagaggaatctattacttcagtaatcacataattttcctggtgcatgtctctcttgctttcttggtttgcctcttgtagtctttgaagaaacaaagagcttcaaagccaggaaaatgacccagatctctttgacagcagtgctaatgttttgggaagtgaaggcatatagttattactgaaattagtgttcctggaagctgcaagttacttgaaaattatgctgatttgtcttgcatgcattgtatttgtgtcctaccaaagtgtttccaaggaagtatctggcaaacaggcaggagggtgccggggcagtgggacggggagggtctgaatatattctgatggctgaagtctaaagaaaatgaactggaacctatttaggacatcgtattgcataagcatgagagtgataatctcatctctctttttcttttttctattggatcttcttaagaaacctgaatagccttgatatgatatctaaaaataaagtaaatggtgctttgatgtctgtactttctcctccatgtaacagtgggtgtatgtttctcagagtttatctcctgtgtgccaaaaatcagagaggctcaggaacaagtgtccattgcttccaagtcataagaacaattggcaaaaatcacttgtcttgtgtctttgaactttaaatgcagtgaaaaaacttgtcttaaccaagagagggataagaaagagctgccaagtttgaaaaacctgctgataaataacttcataccaactgtacaacaacctgtactatatagtctgtagatgaaaaatcatgtaccattttggcttgtacaatactttgtggctaactttaaaaaatacggaatggttaagtctgtgcattaatacgtgctgtgtaacctaacttctcagcattataatgtcacagatatctgggggtggtggggagaagtatatgcagctatgtatagaatatacacagctctccctcctttctcttccttctgccccctggctgtgtggtctactggctggattgcaatagctggattgcagctggttagatgactctgctggtttttgaggatgaggaggacaggacaagagagggaaaattttaaatgtttatatcataggagaatagtcatgtcagaatcattgtgtttccaagctgcagtttgtgctttttaagttaagaggtatgggacttcagattaagagtttctttacagtattatagtttaaaacattggctctggataatagttgactgagtttaaatcctggctctatagttgacttgcactctgaccttcaggcaggtttttcatccaaaaaagtggaaattaacatagcacttattatgtgaccaatatagaggacttaaacagtgcctggtagaccgtaaatggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattctcatgcctcagcctcccaagtagctgggattacaggcatgtgccaccacacccggctaatttttgtatttttagtagagacagggtttcaccatgttggccgggctggtctctaactcctggcctcaagtgatctgcctgcctcagcctgatttcacaatactgggattacaagtgtgagccaccgtgcctagcctgtggaagcccagcagatggaagatttgctgccagagttaatggtgaccggtgggatatacaattgaatctttacagagaatatagagaccatgagataactactctggaatcagttagttttaaggaaccacaggggcagagcttgagataattgggaagtttaacatattattaaacctaaaatggccagcaagactgatagctgcttctcagttgtctgagttttttctttttttgtgaaaatacttttttagccagcatgacttatgtcatctcttagatgagagaaaagagtaaaaaagacaaagtgtatagctactcttttaaaaatagtgttggaagcatagttttggaagaaggtgtctcacatgagtcaattttctagacaagtgaaatttggctcttttagtatcaaaacttgcttttataattttttattgagttttttctaaacttgaacaattcatttatgttatgtttattgagtatatctcatgtgccagaaacactactgggtactttacattgccttgatttttacatataaaatgcattgtgttctggcttttaaacaagatacactggttttaatttaatattttcttggaagactaattgttaagccgttatgtaactctgtgcttagatttcgtgactttcatattttgatcttattattccctacgtgttctcgactttttccacgtagttgagggaagggttactgattgttaattgattatttattatgtgttctaggcactttcacatacatttcatttcaatctaacagaaacatgtaaaattattattatacccattttatagatgacacaatgaaccacagagaggttgagtatcttgcacagagtcacactgctgagtgaggagaggagctgagattggagtatggacccttctgattctgggtccaatgttctttctatgctgacatcattgaagaaatagacataagttaaaagtaggtttatagatcatgacccttcctcacactccctctttcttttctaattctttcccattgctgtaaaagcagggttttcttctctaattaatttagctattcttcacctgtgctagatgcaagtaaaagacagcagaagttagaaaaagggtggagcctccaaacctgttgggtgagaggctggtccatgaaatgacccaggattttctcagagtaaatggaaaatctttaactttgatagagttaatttatagttacaagtaattttgtgtgcctaataccaggtatagactaaggaatttatcagaaatattatagtaaatgagccctttttctcataccaagtcttcaaagttcagtgagggtaaatccaccctcccataaaagcaatgaaaacactagcaaagatagcaaaaagcaactttttcagaacccctgagattagccaaaggcttccaatagtttgagaagtgtttattcaagaaaatcttctgaatcttattaggaacagcagggtttgtgggattgtaactgaactactcccatttcctctcctcagctctgcaatagccttgaaaaccagcagtcttgcaaaacttgtaaaaacggtacttgtaaaaaccaacagccttcaaccattggctaggataggcctggatggaagatcctcaagaagtcccattcccagagcattgtccctatttgacttttctcacagctccttggaaaagtctcatttgcagggcatagttgttatttgacctaccttggagctcagagcttgctctgttcccacagagccctatcttcagggtatttgtcaaaaacaatcagtgacaattgtttaacgtcgtagcttctgaggggtcaataccagttgcgcaaataaaaacctggccaaaaacttacgggtaagatgtgaggaataagatgtccataagaggcttttaaaaaactcttttgacatattcctagaggattagaaggctacacacatatgcagggctatgtgcatgctcagaaggacctgagagggcctcagtgtctcacctctgactgagtatgaggtccggagaaggcaataaatacaagctaaggcagaagattaaagtgcccaactgttgaaggtatgccttaacacacacacacaggacccttcagcaaagattggatcacttattggttcacagcatcagctaaccactaagctaactaaacagagacatcagtggctgcacaccacaagaaatacagactttacagaattagtccagaaaagtcactaaacaaacaaacagcaacaactgcaataactacaaaaaacagcaataacaaatcctggggagttgggagaggagagtctgatttccagaattgccacatttgttattatctgaagtgctcagttttgttttgttttttaacaaaaagcatgagacatacatacacaaacaagacagtatgacccatacacaatagggaaagtagtcaatagaaactgtctctgaaggggctgagatgttggatttattctacaaagattttattcagctactatcaacatagtcaaagaactaaagaacatcatgtctaaagaatgaaaggaaagtatgacaatgaagtttcaccagatagagaatatcaatagagaaattgtaaaaggatctaaagtctggatttgaaaagtataataacaaatgaaaaattcacttgtgagctcagcagcagatttgagctggcagaggaaagaattagaaaactcaaagacaggccaattgagattatccagggtgaggaacataaagaaaaagaataaagaaaactgaacctgaacctagtcccagagacctgtaggacaccatcaagcctactattatatgcattatgggaatcccagatgagaagagaagggtggaagaggaatatttgaagaaataatagccaaatacttcccaaatttgatttaaaaaaatacttgtctgcacaactaatgagtgcaggaaactctaaataggataaactcaaggagatccatacctgtgtgtgtgtcgtagtcaaactgtgaaaagacaaagagaatcttgaaagcagtaaaagaaaaatgactcatcaaataaaagggatcctcaataaaattaacagctgacttctcattagaagctatggtggctggaagtgagtgggatgacatatttaaggtgctgaaataaagagagtctcaacaaagaattctatatctgttaaaattacctttcaaaaattaggaaggaaccaagacattctcagataaaggaaaaaagaatgtgtcactagcagacctgtcccacaaaaattatgaagggagtccttcagattgaaaggataaggcactagatgataacttgaatccacaaggagaataaagagcactagtaaagataaacacagaaataaacataaaagcacaaatatatttttgtaactcatttgggtgatagataactacatagagcaataattatgaactgtgttaacaggcttataatatgtaaagatgtaatttgtatgacagtagcacaaaggagaggagaggaaaaggaatatgtgcagaaaacttactactcttgaaactcagttaatattaatctgaactacattgtgagttaagatactaattgtaattcccaggataaccactaagaaaataactcctttaaataaaagaaacaacaaggtatcaaaaatggtaccctagaaaacatctatttaactcaaaataagacagtaataggggaatccaaaggaatatgacatacagaaaacagagctaaatggcagatgtaaatcctaccttatcctaccttatccataattatattaaatataaatgcactaagcacttctattaaaaggcagagattggcagaatggagggaggaaaactcctgacccaattatatcctatctactagacacacttacacacactttaaatttaacaacaaaaatagtttgaaaataaatgaatgggaaaagatatacaatacaaacagtaactgaaggagagctggagtggcaatactaatatcacatgaaatcaactttatgataaaaattattactagacacataacagtctattgggaagatatcataattataacatacatgcacccaatgacagagccccaaattacatgaaccaaaaactgacagaactgaagggagatatagacaattgaacaataacagtgttttttttagagaaagagtctcagtctgtcacccaggctggagtacagtggtgcagtcacagctcactgcagctttaacttcctgggctcaagtgatcctcccaccttagcctcccgagtagctgggactacgggcacatgccaccacatgtgtattttttgtagagacagggtttcaccccgttgcccaggcttgtcttgaactcctgggctcaagcaatctgtccaccttggcctcccaaagtgctggagtacaggcatgcaccaccatgcccagccaagattttcttttaattactgatttcaaagtattattgtgatgtatagttttattcctgtttcttatgctttgagttcattgagcttcttggatttgtagttttcatcaaatttggaacatttcagacttactttcttcaagttttttttttgttccctcttctccttttggaaactccagttatacatatattaaaatgcataaagttgtcccgtagtttactaatactcttttttcttcaatttttttctctgtgttcccattttagatagtttctattactgtgtcttcaagttcattaatcttttcttcagctattaattttatccagtgtatttttcatctttagaaattcaatttaggtattttttttttgcaatcttctatgtctctaattaactcgtctatgaggattgttgtttttaaagcctttgtctatcaattctattatcttgtatattaatacccctctttcagtaattgattttgtttactcattatgggccatatttttctgcttctttgaatgcctcatagtatttgattagatggcagacattgcgaattttgtctttttgggtgatgagtattttgtatttctataaaatacccttgaacttcattcttggacacagttactttgaaagaattggatacttttaggtcttgcttttataattagtttggtaggaccagtccagcaaatagttagggctgactcttccctactactaaggacccttttgagtactatgcctaaagctccatgaattgtgaggttttacagtctgtctgggagtaggcacaattcaagaccctgaggaagtatgaggtactgctccctcgaatctgtttagatgggttttctcctggcttttgggtagtttcatcacatgcatgcactgatcctacttaagtaggaccctctgcagatctctggggtcttgtttctttttagccctctcctttcctgtgtgctgacctgtgaaccctaaccaccttggtgtctctggaattcttagcatcatctcttcaattcagtgagtcagctaggctttactgggttctccctttctgcactgtggcctggaagctcttttaaagcagtaagctgggcaatcatagggctcatctcatttgtttaccatctctcagggactacggtcctgcatggcttgtgtgcagtgccttgagaatagttgtttcatatattttgtctggtgttttgtgggtttttgttgttgttgttgtttcagagggttaattgaattcctgttattccatcttggtggaaagtagaaatctcaattttttttttctgtagatacttaatgtcactattagtttaagaaaaaatggtcgtattttaaccattcatgggtaagccaacttgtaaaatatgtctgctctatttaagcttatgaagatctgaagtagagtaaagggagtgggggccatagaaaaataaaagagagtaaaatctcccttctttcattctttctcttttgctcttttggtaaattgttgctatgcccccttactaatcagagccccattgttctttttggtaataggaacattttaagagttctgtgaatatgccactcaaaatatatgaagagtgttaccaataaaattgtcatggtctttatgttttaatctatgtgataaaaacttgatggttttggtacaactggttaacttctcgaaaaaaatatttaaattggatttcctcttaatatcttatacccagatatagtccagataggttaaaaatataatttctaaatattaaatgaaaatataggcaattcacagaatcttaagaaaaggtctttctaagtgtgatacaaaggatacaaccataatgaaaaagatcaatatgattacatgaagattttatgtcttttatatggcaaaaatcattataagcaggattaaaaacatagtcgatatccttagtatataaagatacctcacaaagtagtaaaaaaaaagccaaatatcccactgggaaattaggcaaaggatagttgtgtaaaaaatataggtttcaggtaaatatgtttacaatgctgtacttcataatagtaacaattacaaattataatactcataataatagctatcatttatttcatgtttctatttgcttgattacgttaatgttttcagtagattggctaatttgatactttgaaaaacaagtatactattattgtcagtttataaatggcatttgagacaggagattaagacccttgcccagggtgacaaagctatccaagtggctaagccaagattatcacccaggccttctgattctagacccctgcttctcatcattcctcatagcaatacatttaaactacctgaaattcaactgcaacttgcagagaaattggtaatttgctcaagatcacaacatttgtaagtgataaattgagttaaaaatcttacaaaagtcatataagtagaagaaaggaaaacagggtaaagtaaggtgagcaacaaaacagctgtgtgttttaattttagatattcacggtttattttcagaatatttaaaagatgcttcaaagaagatgaaaaatgggctaatgtttgtaaaactggttaacccctgttcaggtaagttctcttctcataacttgaatgttcttaaatgttgtggctaatgagtatatacacttttatgtctttgtgtccttgctctttctgaatagcttttaaagttaagatggcaccgtgaggagaagaaaacaaggtgatgacattactagtcttcccagataattcatttgacttaaacattttaaaaatttcttctcataattttaattcacagaactgttcagccatcagaaatacgggcaaaacaaaaaagtagcatgtttgagttctctttaaaaacagattaattttctttggcttccttaagccaacttttcttagttattcaacattagcctccatttatatccattttatcttataaagtaaaataaacaaccagaatttaaaaaaacaaaaacagaaggcttttacttgacatgccaagattttgattaggttcagttttagctatacttccctattttcttctgaccaaaaagtagtactttttttctccgtcaggggacttttttttttttaaatgataagcattgtttattgaagggattcatatcttattggaaaaattttattttaactttatattcagtgcattttcagttttgtcttcacattttttaggcaaaaatattaaagtgtattctaaatattgagtaatatgggtgatagtgtttatctctgtgtgtaattgtttttccattaatttataaggttttgtgtagacacctgatacttgccatattagaggtttctcctggtgacagtaatacggaatagtaaaagtatgggagggccactgagtagtgccttgttgttatagagacatgtaaatagaagcaacaagagaagaaacacattcctgactttctccagtgttcttttcttcaaaatgaaattgactgtaattggtcagctatatttagaaatcttagttatatatcagactaagttgacgtgagaaatatttcttcaagagaagttttaggtagcagtaaaggttctaaagcatttaagaaaagtacaggtacagaagaaagccagccctcttttaaaatttctgttttatctaaatgctcatagacaacagaggaacaaatgtttttatttgctacattggcagtgggaaagtaaaggctaacatttgctgagttcttactatgtgccaagtattggtttaggaaatttacatgtgttcttttttttaattcttataaaaacccttgaggaggttcagtattgtctccattttacagatgtggaaacagccacaggaaggtttatgtaacttctccaagggcacgtgcccagcatatggtggagatagagttaaagtcagcatccttgtctccagagattgtgctgtggttaaaaaaaaaatttttttttcattagttgaagtgataaaacatgcagatgtgcacagtcttcaccctcttgtgcctcctcccttttttttttttttttttttttttggttaagaaaggaaaggaaaaaaaattcattcagttgaataaagctttactcactccctatggcttcaagcatgtctgtctttctcacttagggttggcctgtggcttggtccctgtcagaccctgtgtggggagagccacacactgcccagaggcagggacccacgtgccagctcatgtcatatggctgaactgttgtgttttgatagtttaggaatggatattccctcttgatctgatggaggatttaaggacaggctttgtattagttaagataaatgacttgcactttctaattttttggtttaagtccagtgaggattatggagctggaaaactaccatctatgtataatagctgtaagctttccttggaatcagttttttagaatagacctgtgtatgtttatgttcatattaggaacattcgtcagagatactggatagtcttttggggtgtgtgtgtgtttgtgtgtgtgtgtgaaaacttacaaataaaagacagatttgtcttaacaggagaaggagccatttacttgttcaatatgtgtctacagcagctgtttgaagtaaaagttttcaaggaaaaacaccattcttggtttataaatcaatcagttcaatcaggtaggtgactagtgtaagcatttccaataactaaacacatactccagcttttccattcttcacacgtggggttgtgggtctgtcaccgggtttggagtctggtcactggtttagccttccttggcatgagagcaggtttaatcaaggagaaaggaaagatcatttgagcactaaggttaagtcatctcctgtgtgtcttagacggtaggaagttttaaactagcaactctgatttgtctcctaaaacagtgacacatcctgagttagaagttagatttgtacatggggcacatattgtgttgattagaaactcttttgaggatctttgtgtttttaacatgttatttccttgaaactggatactgatatggcttctaacataggctagagcataacaaagtttctttaaaatgctttgtcatatacctgcctgcccacctgctcccccacccccatacacacatacaccccccagcaccaaagttctgtttcttgtggtgttcccttaatttgggggcagtgctgactaaaggaagagtaggccaacggaactgttctgcctcatgttctggggtgggggcagtcagtggctattcaaagaatcctacatccccctgcccacagaccacggaagggactgtgtatagagagaatggcactgctttcccatggctttgtcctcaaaagcacaggaaattacattttactgcagctttatagatagactgacgatacaggttccctaacattgccgtcttctcattctgtctgtgcttcctcctaacccctcgtttttcagggggttgggaggctgtgttaaaaatgatttctaaagaagaaatggaaagttaaagatcaatttcagggtcttggttctcctctccacacagggatttgaagctctttggagtaaaatctcatagagcacattctgccttttgagagaatcacatagactctgaggcctgtataagaagagatttgaatttggaatttcacatatatttttcaacactgtttttcactttgagattaaggtgaaatagccacattgtctttccaagacgtttaattcccttcatcctttttgtaatctgcaggaggtcttctccattttgccacacctgtggatcctctatttctgcttctccactacctcataaaggctgataaggaggtgagtttccagctcggagcatccacagtgaggaaacagaatcaactatttttgtttgatctcctctctctccttttaatgatccaaaggtggattctaccttcagatctattatagtgactagagaaaacatgaatcatatgggccagtgcaggacagagcactactgcacaggccagagaagcagcaccttactcttgatccagtctgaccctggcttgcttgtgacctctgacttgcctgactcactgtgctgtgcaccttactgcttgacaaagcctgacagctaacactcctttatcattaagtattccttacacttgaaatacaaaacaggtatttaaaaattgaccacatgtcttaaagagtctcttctttagtgagagactgtggaataggtaaactggagcgggtccaatagaagctcattaatggtgatgtgctagttgagacttaaggaatcccagatggataaaatttacctttggaatagaaataaagacacagcttactaatagtaataattttagccagaagttctgtaatattttggtctcaggatacatttacaattaaaattattaagggttccaaagagcttatgtttctgtgggttctagcaatactcttagaaattaaaactgagagatttaaaaattatttatttaaaagttaaaaataataaggccattacatgttaacataaataacacatttttattgaaacaaacaaccaaatttaatgaggcgtgtggcattgttttacatttttgcaaatctctttagtgtttggcttaactagaagacaactggattcttatatctgattctgcattcagtctgtttccatatgttattttggtaggattatatgaaaaatatgcggccccatacatctttgtagttagaaaaggaagaaataatgttacagcctttttagattattgtggatattcttctttaatactgcctaaaaaatcaacaagtagttttttaaagtttagttgcaatgtgaaatgtgaaactttgtcagttaactttctatgctctgttacattaaaatgcattggtctatcttgcacttaaaatggatctttttaccagtgtatgattttgtaacatcatgctttggtcatttggaaaatattgatttgctgagttatgcatatcttccaaatgttgacacatctcattttacacacacacacacacacacacacacactcccttttgttaatattaccactgatctcatcagaaagctctttaggtattgagaagctgtcatagtggcagatagaaattttctacaattctaatttttgcttgaaagctcaaattttattattggccgcaaatattgtcaatctttcccgtgaaatgacaggctcacttcgttcatattctgcctaataccggggtctgaatcaccgtaattcatagtgggtttttcaaataaaaatgatatccatgaaaaagcagctggttctgcttgcaactcagccagccccaggagaacatgctcttcctggtaatcagcttatctttggttaagcagccaaaggcctttagccatacctcactttcatcacagataatttacaagacttgtgttcaagggccaagatttaagtaaaattaattgcttttactacttgctcaaggatattcttaagtgaaactggcattttttaaactgcacataaatggcggtgaggatccaaatgatgactaggacagtctggtgccaccaccagactcgtgctaaagagccagcagttttacccaccattgcatttgaatcatctgtgcagatgtccacacagtgaaaatgcagatagcgtcttagcagtattaggaaaatagctttgagcttaggtacttcatgacccagggatccatcaaccatagttggaaaatcttttaattaataactttgagtgataagtgtcactcaaacagcttagaagaatctggtttttttggactctcatgtttgcataaagtttgaacacttataaatttcttacttaatccttagatcaaattcctgaaacctccatttggtaggtaaattaatttaagttgctgtaaatactgaaagtcataaagtatcaatgcatgttttctcttgatgcagcttagcctcttttagcctcctccttccctgccctccgcccttcactgtgaattagtgaagttttatcccttcgtttaatcatgtgtcccattatctggaagctactgtgatggccggtataacgagggcacacaagctgtgaggctggtaagcctcgtgtctttaaggaacagaaatggtcctaatcaccaccaggaacgccctggggaatattcagggaggaatttgtaaacctcagtggctcacctatgtggtgttttctaggataaattaatgagcagaaagacaccaaccagcctcagcaaatgtattgatctgcacttaaggctccccctcccctttttgatagcatttctccatctcccattaggaccatgactctgggggattaaccctgtcttggcactctgggcacctccagggtgctatggcgagctcacgttgacaagtgcagaatgaagcagaaatgctgttcagggtggcctttggctttcattttaaaccgtcgtacttcccaaacacgtcttcccaagtgccaaaaatgccctttaaagtaacatttgagatgtttaggtatttccttctctacattttagacatgatcatttcctatttagttaaaaattattgatacacacttttgaaatgtgacctgttcttttaaactttattttaacatcagtaaaaataactttttttctaggtatcccactgctactagctttatagtcaaggcaggttgcttattgcatttccttcaatgtatatatggtaaataaaaataagaatgaaacactagttaattacaaaattattttatatcatgattgtatggtagtccattacatataaatattgttttagagtagtcaaatatttaagatattgattgatcatggaagactatagatttaaggtagaaatctaaagacagtaagacttgggaaaaatctgtgcattattcttactatttgaaggaaaaagaacatttaaattgagatagttcatggcactagttaacctaagagaaagtatggcaagctatcacgtgttcttaaatgattgagaagattttacccttaaaacccaagaaagctgcatttgcagaaattgatcagatgcagtttttgtgtcttcaggaggagttgtcagtacacgagaggtagagcgagctagaagtgggtcatgggcaaggccatacatctggtacagtctggtgtccccaaatcagggggctaataccttaatttagacaaacttcacctctacttgctactagtacagttacgaaaaactagacctaattccaaagaatgatgttgtgaatccatatggtctgcacttctggcccactggcaaccaggccatataaacttctgtggctgagcctgatttagcctgtctgcagcttcccatgacttctccctctggctgtcttttcttttattctggtctaaatttggaagcattgtgaggcagctttgacaggggtagattcacttttgtattttctttttgtggcgggtgcttctttcatcatccctagagtgatgatggggaggcagatgtatgtctgggcctggtctgggcttgttccaatgtgacagtcaggactcttgctctgtgaccacagctggttcttcaaattgaatgggttggaccatccccaggcagtctccaccatctttgcaagcttctgtggcttccagtgcttttgtagattgattttcttccccatttcatttggggactgtacacccaaggtagatggtgtgctgtgtgggactccagtgctcacaggagcttcctgaagggagctggggtccgtcctagagcctgtcccattgtagggattccttagatggaataggtggcttctgcactaagtttaaaggcccagccatgagttaatgtgtctttttctctttttttctgaatgtctttgttgaatgaaatgcttgctttccaactaactgttttttcaggggaagtttcagccccttgatcaagttgtggtggataacgtgtttccaaattgcatcttgttgctgaaacttcctggacttgagaagttacttcatcatgtgacagaggaaaaaggtatggtataacttaaaggcttatggctggtagaaaggatggaccttgcctaagaacgtggctgcttacagacacactgaatgtaaggcttattctgtgtccaccatagggaaaactatcattcagatttgctaacactgccagcactgttcctctattgctttggagtgtttagtctttggaactacaaccatggcagtctagggcctacgtccacagggcaggaatcacaaggtgtggcttcagtctcacttcttctttgaactagttctgtgacatcaggcaagtcactcagctgccttctgcctcagatgtctcattgtaaaattacgtaaaacctgtaccttaatagatggaagcatttatcgagcaccttccaaaaagcatatgttgcacattagtgctaagctctagatacttatgaataagacattgtccttttcttcactttgcgcccagtctgatgggggtcaatgacaagctgagcagtgaccgcacagtgtaacggaagtgaactctgaatttactggggatgcacaggacaggtttctaatctggcggggttgggtggggaatgtaggtgggtagatgttgtgttgctttcctgggggaaatgacctctttatggagtcctgaaggatagtcagagaagcagtgtaacagaggctcagatgtatggaaaagtttgtcaggttcaggaagttccaaggagttcaaagtataggattctggggaaggatgtaggttggtaaggaatgaggcgggaatgctgggcatgggtccagatggtaaagggccctgtgtgtgtttggactttgcttaatggtagtggagtgtctgtgaagttttaagcatggcagtctgcagtgtggagagtatattggagaagccaggtccaccaaggctgttgcagtgatccagacaggagataatggtggccttgatcttaggagatagaacaagaagaaagtagccatttagagatggacccaactgcatctggttgttgggtggtggtcaaggagaaggaggagtcaagagtgacttctcggtttgtgcctgacccaaaggatgtgtagtggtgggatcctggacacagggaacatgggctggaggagcaggatagggtaatgaagagatgcgttttcactatcattcatttaatttttcagagggaaaagtaaggcagtgtgtgtgaatgtgttttgacaggttagaaatagtataaaaacttggctttggtgtcttaaaaaatcatccaagtagtttcagggttaatatggaaacaaagtgtgggaaccagagcatcaggctgataagttgtggctgtttgggtcatagatggtttggccaactatgacagttcttctgggaccaagaaagtggtgattccaagaagtgtaagcttacagtgggaaagagaagaaccttattgattgcattttatgtttaaggggtccagtaaattcatacttggccacacttggagctccagtttggaactgaggggtatatggtgccagggttttatcaaagcagttccattaaagacattccctgatgctgagtttggcagaagacagcagtctttttgtgggtgacctgaattagcccataaccacttttaaaagataaagtaatgaagaataatttaattaagccatgttaatttttgtcaacttaatgcaagctgaaaatgcagttaactcattgtccagaattctgctattagctgtataagaacaatcatcttaaaacccagaaatccagatttagaaacaatgttagtgcctcagcatttgtttccttacagtctgcagccgagagcaagaggctctctctgtgtcatcccttccctcttgtacaccgaactcctgaccatttattgcatcattatctgaacttgtcttagtctcctttgcttctcaatattgcctaacttttggaagttctgtacttccattttcaaagtagctatattattagcctttatatttgccagatttcaaaaaccctaggcctcaatttttttctttatttttaagtgatgggcaaaacataaaatactttagaataaatttcacacagtaaaagatgtattcaatctctagaggtttggcagtttctttttatcaaattcttcccttaataagctgcagcctgtgaatctcaaaataatggaagttttaaaaacagaaagaaaaagatttttatttttatttttttatttttatttttttaagacaaggtcttgctctgttgcccaggatggaatgcagtggcacaatcacggctcactgcagcctcaatctctggggctcaagcaatcttcctacctcagcctcctgagtagctaagaccacaggcacaagccaccacacctggctaattttttcattttttttggagagatgagggggtctctctatgttacccaagctggtcttgaactcctgggctcaagggaacctcccgcctcagcctcctaaagtgccgagattataggtgtgagtcaccatgcccattctcaaaaagatttttaaatggggggaaaaatacgtaagattctcaaatgcctcatccttaagaagatattggaaaatcaaatatctaaaaattaaatatataaaacctaagcgggctttattgcaagaattcataattggttgagcatttaccataatttaccatatttatgcattacaaaattgtatgattatctcaaaagacacagaaaaggtatttgataaaattcagtcatgatatatattatcagcaaatgaagaataaaagggaacttccaagggcatctatggcaaacttaaacagctaacatcatcttcattgtaaaagactgaacacaatcttcccccaagactggatacaagagaaggatgcctgctcttaccacttctattcaccatgtggtggatgtcctagcatgtgcaataagacaagaaaaagacatacagattggaaagtcagtagtacaactgtctttattcatagacaatattgtcatgtatgaaaaaatccaaaagaatctacaaaagaagttactagaattgataagcaaagtttcaggatacaagttcaatatacaaatattagttgtgtttctatatactgacattgaacaattggataatggaataaaaacataccatttatactaccattaaaaataacattctagtgctaaatgtaacacaatatgttcaagaccaatatgctgaacattacaaaatattgctgagagaaattaaagaaaaattaaataaatggagaaataggccatgtttgtggattggaagactcaatatttttaaggtatctattttccccaaattacactataattacactatataattacattatagattcagtgtaatacttagccagctccatttttttttctttttttttggtaggtattgataaactgattctagaatttatatgactatgtaaagcagcagaagcagcagtctccaacctaattttggcagcaggaactggttttgaggaagacaatttttccatggatggggcagggagggggatggctttggggtgaaactgttccacctcagatcatcaggcattcgattctcataaggagcacacaacctagatccctcgcatgtgcagttgacaatagggttcgcactcctatgagaatctaatgccatcactgttctgacaggaggcagagctcagccagtaatgctcacttgcctgacactcattcctgctgtgtggcccagttcctcacaggccatggattggtaccagtacatggcttagggactggggagccctgatgtaaaggacctataatattcaaaacaattttgaaaaagaagaatttggagaacttacacaaactgaattaaagacttactataatcaagaaaatgtggagatcaggcacaatgactcatgcctgtaatcctagcggtttgggaggccgaagcaggaggattgcttgaggctgagagttcgagaacagcctgagcaaagtagcaaaaccccatttctacagaaagtttaaaaattaggcagctgtgggccaggcacggtggctcacgcctgtaatcccagcactttgggaggccagcgcaggtggatcatgacgtcaggagatcgaaaccatcctggctaacacggtgaaaccctgtctctactaaaaaatacaaagaacattagccaggtgtggtggtgggcacctgtagtcccagctactcgggaggctgaagcaggagaatggcatgaacccaggaggcagagcttgcagtgagccaagatcgcgccactgccctccagcctgggtgacagagcgagactctgtttcaaaagaaaaaaaaattagccagctgtggtggtatgtgcctatagttccaactatttgggaggctgaggaggaaagatcacttgagcccaggaggtcggggttacagtgaactgtgatcacacaattgcactccaatttgggtaacagagtgagaccctgtccctaaatttaaaaaataaataaaaataaaataaatttggtgttggtataaggataaatatatagataaatggaatagaatagagaatctagaaataaacccacacttatatggtcaattgattttttttttccaaaagtgtgaagataattcagtgggaaaaaggatagtctttacaacaaatgttgatggaagaatttggtatacatatgaaaaataacgttgattcttacctcatacagaaaaattaattcaaaatggatcactatgttaaattcaaaaatgaaaattattgagcttctagaagaaagcataggataaaatccttgttgtcttgggaggcaaagatttcttaggacacaaaacccactaactgtaaaaaaattataaattgtattttatcaaaagtattctcttttgtttttgaaaaatgccattaagaaaaaaggagattgtgagttgtgggacagttggaacttacctacctggctgtccacggcttaaaatgatatagccacttgacaatttcttacaactcaggaattctactactccctggtacaaagtaaggaactactgctagctgcaacaaaatggatgaatctcacagaaataatgttgagcaaaagaaattggacacaaaaagtatatactatatcatttcatttctatggtgttccagaataaagcaagaattgccctataatgatggatgagtggtgacctgtgatctgggtagccatgggagaattgactacataagggttccagggaactttgggggatgatgcttacatgactgcatacatttttccaaactcctcgatttgtacatttaaaatgggtgtgtccattgtgtgaacatgaacattgcgtgaacacctaaataaaattcatttttaaaacaatatttactgatccagcactagaagctaagcctcctgatttctaacacagtatttatttttacttgcccctttcccccaaaataatattggctccttttctctctatacttcctacctcccatgggatggagagatggaatgtgggaggcaaggccagtgtgagcactggctctgaggtttaggcctcgatattcaggagagtggtgtaggaggaagatgaaccactgggttttagacacatggaggcttagttcagggctttgggcctcccggttagtttgtttagtcttgttgatctaggaggagatcacaccagatgaaaggatacagttgactttggaggagggtgaagcagagctgggaaaagaatcagataagtcattagagacataaaaaaatagaaagcaattttatatatgccatggaggagaggttgttaggaggtactgaggaaagtgcagacctagtgatcttggtaaagtgaacatcagatccacagctttgatgtcagcatggttgggagttgggtgctcttgcctacttcctcagtgacttaggagagtttacttcatgtcactcagagccagtcttcgaagatggggacaaatcatggtttattaattgattctgagattcattctgatcattcaataagaaaatgtataaaatgtgcctagcacagacctgaataaacattagtttcttatgttttattaacaaatcatatttttcatcacaatatcttagctaatattatgtatttgctaagtggcaggtgttgtgctctaggatttgtatggattatcacatttcatgctcagaatagcccagtgagaaaaaaacctctctttacacatgggggaacaggctttgagcacgaggcggcttcccaaggagacagcatgtgctggggtatgcatgagccctggtagcatggctcagtctgtgctctctgccccttcttagagaataattcccagaggtagaggagaagcctcctagtggggctcagggagtgggagacaggaaggaaaacagcagcagatggtagacattctttgagaaaatttggaggtagaggcaagaaagaagtgagatgccagatcagggtaggattttcaggagaaccttgagcagtgagcttcttttggagtttttttttcctcaggcaatgaacataacttctaaaagccattcagcgtcatatatttatttagtgattgctgtatgctcttaaaattcccctggtttgtacatcggttgggacatgggctccagggaaattgagtccggtctcattggctttggcttacagtaggctgtttgcccaggtagtcctggctccaaaacagcagacattgcaccttggaattctgacactcctgacaatgcttttgcacctgtccctcttttttgttactgtagtgacatgtcctgagaagatggctgcagatgtccagcccccaatccatcctgcctcatcttgcctgcagcattgacaaccataggctgaaacagagaggaaattcacaggaactaaggccagggacctcccaacctctctcccatacagtttaacagactgcagaaaatgaaccctgaatgggcagttttcatttcccatcaaaaggtgggagggagaaagagcctcattctatataactcagaggtggtaaattcacatcaggcccaagggttgctagtggtcataaagataaatcctgcatggacagaggaggctggaatagaagtgctgcccttgctaattgcacagacagaagaaatcccatgaatgaaaagggttgcagaggaaatcatggtttaatgtcatggtatataaggctgggtggattgtggggaagttaagtgtaatttataagaggtgaaacttttatctccataaagggccagattgagcctaccataaatctaaatcttctcaaatagctatgattatgttggtaatatgttaaaagatagatagatctttttttaatgctcccccaatccccaataccaggccactactgagtagttaacaagatttttttcctgaatgtatgtagtgaacttcatagatacctgcatttcgtttcaattttctttattgggattttcatttttattttaagaaaaaaagtggttcattgaaaacattgaggtgagcttaaaattattcagaacagttaagactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaactcaaagtgggggtttccacgttagacatagataggagacaaaaggtggcattcttttgatcagccttccactgaatacacaatgtagtctggcttgagtgtggagccattgctagggaccggccctcttctgcccagaatttccctgcctcctgtccctatcaacaagattattttcctttcacattagtttgctgaggttttaaaattaccttttctacagagttgtttgtataatttgaaggttttcttaaattcttactcatttagtggttgatgactcctgaggtagccacattactactaacatttaaaaaaacatttcaagtatgttctcaggtttgtaaattaagcttttcaagaatttaaacttacaaaatattctttaaatggttaacttgtatatgatacaaccttaggagtttattttttttttaattcattgtgctgagtcttttttttcttttaaggtaatccagaaatagacaacaagaaatattacaagtacagcaaagagaagacattaaagtggctggaaaaaaaggtatagttcctctctagtgccttgtggtaaaagtaaaaattcagttctctaagaaattttcagagaaggcagtaagtctgaatccagagaccatcttgtatattcagtgaaaagaggaaaattgtgtagagataccaagtatgagaagaaggctttgactttttaatcctccctaacttctgtatctctgaagttagctttatgttttcttgtgacctgcattctcgtttctccctgctcctactacggaatgaaataatttgttggtgtagatttgagtcttccaagtaagaggataccaggcttggcacttgttggccactgtcagtcctgcaggtgtctccaagggtgatgcttacacacagccaggcaaagggacccagggacacagccaggcaaaggtgttcaggtttagaggaagtatgtcctgctctcagggtctggacactgatgaggggtcatcttacaggcaaaccctgtatcttagtgattctaagaatcttgacctaatggatggactggggcagtgaatttcaaatcaatttagtaggtaacaaccagtatttctcttggaatgaaacagattgtgatgggatgggacgggacaggacgggatgggatgggacgggacggacgggacgtgatgggacgggacgggatgggatgggacgggatgggatgggatgggttaaaatatagcagaggaagggcaggtattaagtatggctctgtgaaatgtatttatatgtgtttaagtattgggttgctgtatatttcttactatgggttgtgataaaaaaaaaactttgaaagccactggtctaaggataatatgtactttcacattgattaagaatctcgctaaaccatatagaataatgataaagtttttgcaagatcagtggataccagtagttgtagtactgtttcctaagattctcttccatcttttgtgtgaaaagtcatgtttgtctgcatgttctctctcataagtgggagttgaacagtaagaacacatgaacacagggaggggaacatcacacaccggggctgtttcgggggttaggggcaagaggagggagagcattaggacaaatatgtaatacatgtggggcttaaaacctagatgatgggttgatgggtgcagcaaaccactgtggtacatgtatacctgtatgacaaacctgcatgttctgcacatgtatcccagaacttaaagtataataaataaaaataaataataataaataataaataaattgtgtttatttgtcataccatgttaccaggctcattgaaagcctgggaagctggaaatgagtccagtagaataatcagtctcctaatgtgcaaagtagtggaaagatttagagtgccatgtttcattttttatttgtgatatagtagtagtagtattccatgtaggcgaagaatgagaataaatgcggagcagaatccttgatgtttacttttgctcttagccaaggaaaatgacatgaatagcgaagaggagtttatacttactgattatatttcctaggaagtgggaaatttatattattctatttaggaagttattacatataaattttgtgccaggttctattgtaagggctttatttacatatattacctcatttaattttcacagtagtcttatgaggtgaatgctatttttttcccccatttcacagatagagccacagaaaggttaagtaactagccgtggttacagagccaagcccagcagcctgactccagagtcagctctcagttatcacaatatgttgccttctcatattgtgtaggccatggaagtccatgtattgagatcatccagatattgctgccactcagcctttcttcaaatgggcaaccatttctcatcttctggtgtctggtgaagatacttctaggttctcaaatacttctttgcagatctcttaaatggtctgaaggccacctatgaattcatagatttctaaagttaagttgaaaataccctgcctttcccctcttggttgcttcataggttaatcaaactgtggcagcattaaaaaccaataatgtgaatgtcagttcccgggtacagtcaactgcatttttctctggtgaccaagcttccactgacaaggaaggtaagtaaagcattttatcagaaaagatttttgtctggagtaagttgcttatgtgtaaatgcctatcttaggatttaaaaatcttaatatcacagaagcctcatattcctaccaatgcctcatacacattgtggcaggtgtgcatcttatttcagaagcgaagaatatttctaccataggttacttctgtcattcattgatacttaagttatttattcagcaaatatttcttttacattgatagtagtaacaaccctggctatcatttattgagggtgtattgtgtgccaggccctttgctaagttgccactatacaaacatgatctcatccaaccctcccagtaaatttcataatgagcatcttgaggccctgtgcaaagtctcacaactagtaaatgccaaagctgagctacttatggagcttgtctctgaagcccacacttgtaatctttttgtgatactgttcctgtggcacagttgtactgttccagtggctgcatctgtttgcattttcttctcaagatgcatgtttcctgatacagggatcaatatattttgattttagatgaaaattgatttacttggcaatttttcttttaggttattcttttataatctaaaaaaggtatattattttcttttccaagtagagtcctcttatttttatatgtatagttgaataagaacagctatataatgcagttaacaatctcaaatggtgagacagaaattattctgacgttaaactccaattcattgttcccttattcagggtatacatatggctttagtcattacataaataaaaactaggaatagtggcctgtttgtgattgatagtaattcaggcaatctgatttgcaggaatctaccttgcatgtataggtagttggctactgccattctgggagtggtggacagcacctttgccatactgagttaccagctgtcagtgtctttaattggctttaacaatagaagatgagggattgagatagatgattaatggatagataggtgggtggatagatgcatccatggatggatggatggaaccatagattttgttttaaaagtaggagaagggatgttagaggttatttagacagatcatctcattttttaaatggagaggtaggtaacttatcctcaagatcttctgttctaagtctagtgcttttaccagtactctacatattaaggttctgggcttggctatattgccatttagtgtcctgaccataaagtaaactttacatattttacattatttcattttttagatatttaggttggtttggtaccagaagcagcaaatgaactatatgttgactttcttaaaatagttttcttggtctagtcatgactcattggataatgactatcccagatccatgagcaattttaagaagggtcaaatgataactttcagttctccattgacaatgaaaatctcttactgaagactttttgacatcaggtggtccccagacggcagtcattttctatgtaatactgaggcaaattgttactttgacttgagagcagaggagaatggaaaaaaggaagtgagtgaatatcccagcagcaaacctggggtctgcttttggtgctttatatccccacgtggttatcccatcttatgattaagtttgattatctgcttgtattctacataaaatactgaattcaggaacagagttttgaaacattttattgtcttcttatgtaactgtatttctaattgctgccagagctgcattttagtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttagaaaagattacccttttaaaaaagacatgactatttcatattgttgtagatgatttttaaactttatttgtattcagtggtttcaaataagaaagcaaccctgagtttttgtttttaatgtcatttagggagcatctactgtattatacttgttttatcttatatctttggtatcatcacatgtcatatctcatccctcatatcttcccactagtctgaccgatagatattactatccccattttacaaatgagaaaactgaggctagagcttaagtgagttccctttatccagatagggtcagaatttgaattcaggtcaatttgactataaaaccaccataattactattttttttttttgctttcactcctccttctgtttctttcagaggattatattcgttatgcccatggtctgatatctgactacatccctaaagaattaagtgatgacttatctaaatacttaaagtgagtattgattatcttcagtcataatgaagtaccatttgcttcttggtttccccagcagtggggtttccttatggcttatcatatcactgtttatgatacaagattattcttcagctatgtcatatactttgtgctttggggatgatttttaatggatgattggaatgaactgatttgatggatacggattgcaggaactagtgaatgtcaagattggaattatggcttggtctgattttagaggattaactatgttaaaattttatcctcaattatacttaactaatttggttctttgtgatcgttttaagaggaagaaaggagggatggaaagagtagatggaatatagacttttttttaatttacaaaatattgatatcattttcactattatcactagatgttcactaaagggactttatgccaaagacttggaagtcaaagtaatatgaaacacaatctgtgtctttgaggggcagaagaagggttttaagaatggtttaatgtatgttcctttctttataaagagcttatacatttagactttaagttgaaaaagaagtgttagaagtgtttattttctagatttttgcaaaatcgttacttaattttgttgttaagattttatgtgtgtgatgatttaatagcttttcctgatccttataaatcctttttatcctctgagtcatgaagataaaatgactttttaatagatacagttgttggttttagcaaattccagaggtcctactttaaaaaacaatgattggaaactggtttctataatagttaaagtgtgctgaaagcctgcttcaaattgataatcatatccttctgcttaatatatccccagatttctatgctgcttgtcttgttagagacctcatgtctttgtactccattgtttgtatagattcctttctttccactaacatttttaagttttggttgaagagttcagaagaaaggtatgccaattaaactgctttctaatggaagaaaagttgaaatttatgtggctttttgtgaacagttaaaatgattttcacctttaaatatatgttagcatcttcactatgaagaaaaaatactccaacaccgaaacacaaatttatagaggctaaagaaaaggaactctgttccaacagatgggttctaattttattttttagttcagacaacaccaaaacaaggacttacatatcaaaataaagactcatttattgagaaaactttcattctttacactgagttgattgaacaggaagatatatggaggtaaagctgtaagttgaaaagtaggacttactaagtcttaagttggccctgtctttctgtttgtttgtctatgaaaaacgatgactttgattgttatttttaactttcttaggcttccagaaccttcagcctcattgccaaatcctccatcaaaggtaagaagctgtgactaagatatctttgggggacttagaaaaatattacactcttaccacatgagtttagttggttctaatatattttaaggtgtactaaatccattttgcatggagtgatgccatgtggaataaagattgtactgggctctccatcactattttttatttttgtggattccacctgaatggtaaataaagtgccatgaaaacccaagaagagttggttttagcaaggtacccctgtgaaaatattaaagacatatagttaaaattaaatcttcctgcattagttagatcacttaattaaatttagtaatcactaagcatactctatatataactaaaactcattttgccaaatctaattgtcactggcacaaaggtgaacagaaaacaatttccataatacaaagaatcctttgagcaaagatgatcactttttttctgaatttgaaatgattgatgaatttacgtgtaatctttgttagtggaaaatcttttcctcattcattctcaggctgctacccacagctcctctgcagctggtatgtttatctcctagatccagagaatggagaagccaatcataaaccacacctgactgcaaattgcagcgttccttcagcccaggccagatctcagatgagttaaactctgctccaagacagggaaataaacatgtgcaccagcttgtcagtgaggtcatttcttcagccagcaaagtaacggatgccttgagaatgtaaaatggacatattgtggatgttacaaactttccttctcccttgcattgttttcttggccttcaaggtagctaaaatgctcataattttttatgtcattccctgtataaaggtggtggtggctccaaagacattgtccttagaaaaggacagaaaattgaaagtacagcagtgtttgtttgggcctatgttcagcatgttgtcaaaaaaaaatgcatgttttactctcttggagaatagcactgggcagaagtctgttgctgtaagatctaaggactgctctaggccagacccatgcgtctttcattccggtagttaatctctgacagtagctctagaggacctagagaggcacagttgtcttgctgaaactaagagggtaggttctcagcgtgcttcttatttttcttcatccaaaaatgaagcagatttttttctcccaaatatctatcttccttagtaacttagagatcattcatgaattgatctaaacctattcttgaaagctttaaccttggataccttttggagtaatatgtttcataactttattcttctctgctcctgatttctgttttcttattttaattttcagaatttaagttgtttgtgacttcatcatttatgatttagatcagagatcagcaaaccttttcttctaaagccagacagtaaatattttaggctccatgaagcagatggactctattgcagctactcaactctgctgttgtattgtgaaaacagccacagataatacataaacgaatgagcatggctgtgttccagtaaaacttcatttataaaagcaggcagccagctggatttggcccctgggccatcatttgccaagccctgattttgattttggcatcttgctcttcctaaaccccagccttgtcttctatattatttgagttgcttttcgaggtcttctactctgtgtctttctggggttccagtgtacacatgacaaactatactagacgatgtaccatcgtttaaacaagcgtagaacatatcttctgctagctttcctgtctgtatccaggatttgattgatttttacagtaatatagttgactgtttccaggaaatatattccagtagtcattaggtatctttgtatctatgttgtaatcgatagcgtggagcctgtcatctttaatatgttttatattattttcctttactatcatatgtctgcctttgttgaaactcagcttccaaccctcacttgctccagtcttttcaatttgtcactgtcagcaagcagagttgaatgcaaccagtgggtttggagatgttcccgagttccttcttgcaaatcatttgtaagaaggcctaacattatccctgtggtactctgcagtttgttctctttccagaactgtatccatttagtcatagcctttgttactgtctttctgagccacttctctgctgaaacaatctcccaaatccatagggatttggtcttttaaataacaaaaattttagtaaatgcttcaatcatctttttttccaatatattcaacagtgcactgggaataacatacaaactagttatatgtagaggctaccacaatcattttctttttttaaacacttgtaactggtatcttgttttgttgtgagctattaaaacacctgaacaagtcatttctccaattaaacattttatgtccatacaaaagtacctttcatcttaagttcttgtaatgaacactttttatttgaattatcaatgaaaagtgaacctcatcagttcagtggcacacacttgtagtcttagctactcaggaggctaaggcagaaggtcgcttgagcccaggagttcaaggctgtagtatatgatgatcgcaactatgaatagccaccgcactccagcctgggcaacacagtgaaaccctgtctctaaagaaaaaaagggaataatgtctaagtgtttataatgacatctgtgttaggaacattttgccatagagaaggaacacaagcatcctcataacttcaagctttttgtgttttgaaaatattttggccttcagcattattagctgtgagtttcaccctcctagctgaagatacctttctagtaaaaaatgtgcatcacctaaacaccctttgctgtcttaatttaaatagaaacatgtatttttttttttgagacagagtcttgccgtgtcatctaggctggagtgcagtggcacaatctcagcttactgcagtctctgcttctcaggttcaagcaattcttgtgcctcagtctccggagtagctgggactacaggcacatgccaccatgcgcagctaatttttatatttttattagagatggggttttgccatgttggccaggctgatctccaactcctggcctcaagtgaccgcccacctcggcctcccaaagtgctgggattacaggcatgagtcactgcaccaagctgaaacatatattcttaacaaagttgcaaatatacattcacttggtgctgataggtggttcatttgtgatggattagtctttttcttttaatgattcatttgctagaggttgctgtgtggccaagaggttttcctatagtgtgtggtatattcccaggatgagcctctgtttttttacagcaaacaattttaagacatggtgttttatcctcttgggttatgggataaaacaccatgggctgtggaatcttttagcaccaactctacccgttctttgtttagcaaagcaggggcatgaagaatgaagctgggaagaagtctgtttcctaggttagatccatgttgggtctggtcaacctggtgtctccataaacagcctgaaaattataaaaatctgggttgtgatcaccatgcagtcaattctccatgttcaacagcaagacttgtcttccctgcttttgtaccttttacataataagtgtggcatgatttcttctatattgtgatcattaaggccttgacaagattctcacattcactggtgtaaaatgttcatgtgaaaggagaaaatattaagtaaaggtctgacttagttgcattgggcctaatggaaagaacactgtatcagaattgaaatcttggccaaagtcctctacttggtgaccttaagctattcatttagcctctctgtgcttccctctcttactggctgcttgcttgtgcaaggttgttcttgcatggataaagtaagataaatattgtcccttcattcataagtggacattaaactggcccaggaggtaaatgaaatagggattctggctggacacctggcccccttcaagagactattctcattttgacttctgtgccttgcattcatctggtaattagcaatcccctcatgcccaccacacctggcacctacaaagcctgtgtttgctggaccagctaaggggctcagccatgtacttacccaatcatatccaccatcaccaaggctgcttcttaggagtgatgtgtggctcaattccctagatgattggcaaaatgtaaaggagcctgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgcgtgatgtgcatgaatacatgaggaacagttgcacgcttgattgtgattacagttttgaccaggaagaattattaacttgcatttctgtgacttaataattaagaattgcatatgacaatgaaaatgttaagcaactaagacttattattagtcagagaaaaacaatatactacttatcaagagtgtgcctaaattttgctatgtattcatagagtgatagggtgggaaaggagggaggaagctctacaggtaattttttgtcaaccctgctgcccagaagcagaaattatgatgataaaaattaataatttcaccattcagcattcaccctggcaaatggcattttggtaacagtccttacttagttttatacatgcattataaatacatatgtggcctttaacattggcattataatactcagttctgggctttttatttaacattaaattgtgaaaatgttcacatatcattaaacattctttgaaaaaatattcatgtttttatgatattcagtcatgggtgtttgtttcaccatatggaatgtaatttaatcatttccctatatttggacatataggttacttctgatttttttattttttgtttttattgaagtgatagacattcttatttacagtctgtatctccaatcatttcattagacacaattttgaactaagactaagagcttggagaacatgaattctttcataattgaaatatatatagctaaagtgcttttcaaaaatggagaaagttgtgcttccaaacattattgccaatgagtatttatcttgcatttttgacgacattgagtattgcttttattcttgaacattgttgcctgtcaaattaggctacatttctttaactagaaaggttctttttccaaatgcttatggcccatttgcatttttgcaaattgttggttcctgtcgcttgcctgtttttatgttgagatagtaatgtttctctgttgctttgtatgagctcattctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttaaatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttctctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaatgtta

SEQ ID NO: 1958 - DNA, 3266 bp, Homo sapiens
ttatggtccattcgagaaattttattggttaaatgatgcccagatggggtcacatcctcagaacttctcagcctggtagcacaagtggatgcttgaagaaactcagtcttggaactcagacagcaatggagacgggatgtgagtgggaccagcaaggggctaaggtccattatgagggtgaggaagggcttctagaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggatggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagagccatgcaaagttcttggtggggagggggaaagggcccatgctggcttaggggctctaaggcgcccagactcacaggtgctgtgaagagctcctttattggggtgatggaatcggttccaaagagctggtttactgctgtgaagggatcgcagctttgaatttcaagctctggttctcagtcctcgggcacctgtgcgtgaatctgcaacaggagtcgcctctactgttggacttgtaagacagggcggcaagctggcccccatacccgaggaaggacccagctgttcagaataaccgcttctagacatgctaggaagagtggtcagggagctacgcttcccacacactacccagtagaatcctccaggctccgtctgcgcaattgtgctccccagcccatccacccgggggcaagacggaactcctcgtctactcaccgctgccgcaaggctgggccaagttaaggccccacgcactttggcatccgggccagggatggtctccagaccccacagggtgaagcggctgaagttggcagtggctccaatgaagcggtcctggggaaggggcctggctcagcatcgggactacagctcccgcccgcaccccctttcaaccctatccctttgctcacgaagtcccgctccagcggctcctcctcttggtcgtcagtcccggaatcccgcaaggggtctggcttccccatcgacaccttcttctcttctgtcaccatcacgtatcccacgaggccaggcggcaccgccacctcctctccccgtagacagcggccccgaaacgacacttcgagtcctggagcgggaggcgcaaagggcctcaggcaggacccacgctgggtcgagcccggagctgccctcccgccacctccggacggaccacgatccccaggagcccaggcgatgagaagcgcgcaggccggcgcgggggctgccgggagccgtagtccggccgcagggctcaccctcggggccctggcggatggcgggcgtgaagaagcgccccaccggggcgggcccgtccaccgcaacctcgcagggcagcagatgcagtgtggcgggtacggcgtcgcgcaatgtggcggagcgcaagtggacgcggtgcctctcgatggccgcttcgtcgccgctctccatcctccctcctacgcgacgccagggctcgcgagctgacactgaagctggcgcggaaagcgcgcaggacctctcaggaagcctccgcggggcctcacgggaagccgccgcggagcttcacgggaagtgtagtccccttaccccctaacgctttccctgggttcaagtcctagggttttccag

SEQ ID NO: 1959 - DNA, 15626 bp, Homo sapiens
taagacaatttaaagttttattgagtaagcttcacaaatgggcattttaattgacatgtccaggtgctcattacaaatcagagaaccaaagcttcattttaaaagttaaagcaatcttgctgctcataaagtattttttaagccttaaatttgttcctaatcaacatttaatttcattcagtggtatctatttatccattgctagatacctccttttcagaaagaacctaaggtactgttttattcccattacaaagctccatctcaaccaccacaatgattcatggaaagaacatcagacttagcaccagaaaatttgttcaaatcaagatagtaacacttcctagctatacgtcctagaggaaatcaaaatgtttctaaccttagtttcctcatcagcaaaatagggataacaatgttgaccttaaaggattgttttgaaaattaaataaaataaaatactcagatgtaatgtatacattataaagcaccagaaaaacgtaagacagtattattattcatgtacgaagatggttcattcattattcaatgaatatttattaaacattcccacttggcagactttttgcttggcagtgaagatacaaagtcaagaaaagacagccatcgcccgtgaggagcctacattccagtggaggaaccaaaactaaaaggcggaggaaagctctgggtgcttgggagccagaaggagctcctagactgggtatgggaagtgagggaggcctgggagcctcctgtggggctgacaccagaaggaactccatcactacagatccagcaagagtaaataaatctgagtccctcctctgtggggtggtccacacactccacagtcctgggccttaagctagttcaaaagcatcccagccccttaagtcaggttttctcaacctcagcaccattgatatttttgtctggataattctttgttgcaggggctgtcctgtgcaaggcaggtttggcagcatccctggtctttacccactaaatgccatagcatgctccccacaaagctgtgacaccaaaaacttcttcagactctgccaaatgctctcttcagtgcaaaattgccccccagttgagaactactgccttaaggtcatggaaaaccaatgcagttggttctggaaggagtggaattcatgcatccagtgcccagacttatactagatgctcaataaatactgaatgaatgaatgagattcctggaacccctatatatgttttgggcctcatctggaagagccctggaaggatagttaagttttaaggtgcccaaatgagaggtaccaataacaccacataaatttataaagtgctaggtataaattgaataatcttgggccagtagctcacactctctgagtctcaggttcctcagttcttaaatggggatgataatccctgttttgcaagatcattgggaaaattaagtgagagaattgtaacatatgcagcattaggggtcaaggcactcattcttttggtgcaattgacaaaaggaatcttagcagaatgtcctcccagttagtgggtaaagcttatggactagtgtagtctgggtatatattgcttttgttatagacatatggaatacacgatgccagggactgacatatcagctatgcaactcatccctcacaagcaacctggtgagttaaaaggcccagaatgttgtgatttgccaaggactctacagctaataagtagttccctgaactccagcaaatcagtccatcagcacccagggctggccaacccactggccccaccagctccatcacactgaggcttgtttggactgtgggtttgggggaaatgctttctatattctgtgttctgtagttttgtgtagacatagatcaccagatctggaaatgtcttctgaaaatacagggaagggtctccaatttttaatttcatcctgaaataaaacacaaattgttcagcatgcttgccccaaattattcttccccgcttcacagcatatggccctgaagatctctttgctcgcttgatttctattgcagaatgaataaggactttggaatctgacagagcaagactcctcccctgactcttcaactaattgtgcaacctttggccacaatctttctgaactttagattgttctttcataaaatggaaatagtgcaatgccacaatcctctacctacaattccaaaatccagaagagccctgaactgcaaggcttttttgtgagtttgcaactaacatctttgtcagcaaaagctgatctaactaatgtgggctatttttagacgtatataactctaccttcactttatctagctgtccagtctcctgtgttacttcacagaagggagtcactagctcctgttcaatttgttttaccatttatccaacaaaaaaatgacaaggaagatgaaagcctgctggacatgtccctcattaattgtaaggcaacagtgatagcccttttacacacagagggaaggaattacttttctttcatcaaaataaattttcttttttccatcgtagatataaacttagaattggattttttaaattgttctcatttcacatataatttgtaggaatgaaaacaatacttactttttatgcttttcttcatcaatgtgttctcccaaattccggatgaactttagcagatcacccacagtgttctggtagaaattgcctcttttttcataaaacttattcatttttttcataacacattcattaatctaaaaaaacaaaaaataacacaaaaatgtggtagcaacacaaaataaatcctgatgaaatattcataccaaaaggcaaaatataaatttgaatatattcatatattctataattaccaactaattaataaagcaaaataatttaaaaatggaagtaaatgctgtataccaaaatgctaactataattgtgtctgggctgggtggggtggctcacatctgtagtcccagcactttcagaggccgaaatgggcggatcacctgaggtcaggagattgagaccagcctggccaacacagtgaaacctcgtttctactaaaagtttctgctaaaaaattagccaggcgtggtggcgctgcctgtaatcccagctacttgggagactgaggcaggagagtcacttgaacctgggaggtggaggttgcagagagctgagatcgcaccactgcactccggtctcagtaacagagcaagactccatctcaaaaaaataattttttttttttcaagacggagtctcactctgtcaccagggctggagtacagtggtgcgatcttggctcactgcaacctccgcctcccgggttcaagcgattctcctgcctcagcctcccgagtagctgggattacaggcacccgccactatgcccagctaatttttttttttttgtatttttagtagagacagggtttcaccatgttggccaggctggtctcaaactcctgacctcgtgatccacccaccttggcccccaaagtgctgggattacaggtgtgagccgccacacctggcaaaaaaattaaaaaaattttaaaattaaaactatatatataattgtgtctggatgtgagattataagtatgttcaaatgtgtgtctgtattttccaagtaaattgttttcataagaaattaaatatattaaaatatggttaaaaaatctttgactactatactaggaaagtcgttcattatactatacaatatttttatcctgtggccaccctttcaaattcgtacttgattacatgtctttctttaaaagggctattcagactgaaactgggcctggcaaccatggccaaagtgaacggttttgtttgtttgtttttgtttttttaggtatatttccaaaaggaataactaatattgttaaagtgatcaccccgcccaaagcaatctacagattcaatgcaatccctatcaaaataccaacatcatttttcacagaattagagaaaaaatcctaaaattcacatgaaaccaaaaaagagcccaaatagccacaggcatcttaaggaaaaaaaaacaaagttggaggcatcacattatgatatacctccaattattgtgcaaggctaagataaccaaaacagcacagtactggtataaaaatagacacatagatcaatggaacagaatacagaagccacaaataaagccacatatctacaaccaactgatcttagacaaagtcggcaaaaacatacactgggaaaaagacaccctattcagtaagtggtgctgggaaaattagactgccatatgtagaagattaaaactagacctctctctctcagtgtatacaaaaatcaactcaagatggattaaagacttaaatgtaagacctgaaactataaaaatactaaaagaaaacctaggaaaaactcttctggacattggtctaggcaaagaattcatgactaagaccccaaaagcacaagcaatgaaaataaagaaacagatggggtttaattaaactaaaaacttctgcgcagcaaaagaaataaacagagtgaacaaacaacctgcagcatgggaaaaaaaatatttgcaaactatgcatccaacagaggattgatatccagaatttacaaggaactcaaacaacttaacaataaaaaataataacaccattaaaaagtgggcaaatgacaagaatagacatttctcaaaagaagacgtacaaattgccaaaaagcatatgaaaaaatgcttaacatcactaatcatcagagaaatgcaaattaaaaccaatgagatatcatcttatactaggggctactattaaaaagtcaaaaagtaacagatgttgatgaggatgcagagaaaagaatgtactgagtatctgccaaaataaagctgtaacctctgcttcacaggctgaagcaattctcatgcctcagccgcccaagtagctgggattacagacgtgtgccacaatgcttggctaagttttgtatttttagtagagacagggttttgccatgttggccaggctggtcttaaactcctgacctcaaatgatccacccatctcggcctcccaaagtgctgggattacaggtgtgagccactgcactcagcccaagaaatcttatatcaaaaagataccggcactcatatgtttactacagcactattcacaatagcaaagatatggaatccacctaagtgtccatcaacagatgattggataaagaaaatgtgtctgggccatttcagccataaaaaagaagaatgaaatcatgtcttttgtggccacatggacggaactggaggccattattttaagtgaaatgacttacaaacagaaagtcaaatatcacatgttctctcttataagtgggagctcaataatgtgtacacatggatgtacagagtggaataatataattggagacttggaaaggtgggagggttggagggagagggatgagaaattacttaatgggtacaatgtgcgttattcaggtaatggttacactaaaagcccaactttaccactacacaatatatccatgtaacaaaactatactagtaccctctaaaatttatattttaaacaaggttacttgcttctccttgcctgcaggtgtcccagggcaactcctttcatatcacagtaatgtcatcctctttgtctgtgcttgtcaccctcatagatacagagccatagatggctctcatatttagaaagagtttgggctacgagatcaagatgcaacagtcaagaatccagtgggtcacttaggaagagtaactgatgaaagagcaatgctagtgaggatgctgctgagactggccaggtgcactctgtgcagaacacccgtgagaaacgccaagcacgtatgtgtggcaggatggggcaagtcaagaaccaatacagtcatacaagctggaaaacttgggctccagacctatgctgacaaaattaattgtgtgaccatgaaaatgggcaagtcaacagaaaaacaaagtgtaaaatgggaattaaaaggtaaaacttgaagttaaaacctgaagactatcaaaattcaatataagcccatggaatttagggaaaagaaccaataaattgggaaataaaagaacaagttcctctttccaggtctgccaatctctgactgtccagcatgagtaatttgagtgtggtctctgagcctcaatttcctcagtgagtaaatgagttggtagacttgatgccatcacagcttcatgtagtggtgtggcttaagcacatggcctctgcagccatccttcccagcttcaaatcctggtgcaccccttactggttctgtgtagttggaaaaattatttgtctgtgcctcagcttgctcatctgcaaaatatagatgattgtctcagaagttgtgctaaagattaaatgtggtaactcatgtaaagtctcaagaactatggctgccacataatcataatgatactacgtaatcattagctatcactatcatagctgctttcaaatttctttgtttctacaagttaaaattttagccaaagtttgatagacattcatttagtaaagagtcatggcacatctactccatgccagggatacaataactgacaagacaatgggtagtctctgccttcatggaacttacagtctagcaaggaaaatggaccgtaagccagtaattatgagtgtgatgtgcagtctagagaccagtgagggaaggaaagcaaaacaagaattaggagaagcagagtcccaggtcaggtctaggataggaagctgttggtttccaagacctgaagattatgggttctcccatagtgctttgcacatgtccctgggatgcccagcacacatcccacagcatcatttccatgggcttctcagccccacagggacacattgtattctgctttgtatgctcaaggccttgcatgggcctagcacataattggtattgtatagatgtttgttaattaataatgaaagttctgacagtactgactagattgagatgatgactaattttgtagagttccactataattaatgcaagttaggtggaacttttcttaaagagagcaatttgaaagatcatctttccttcatagtctatttcctcaggcagaatgtaggtctgtgtgtggatcctgagagctgggctgtttacaggcagtggaggcagccaggctgtacctggactgaaacacctcatggtgaagcacttcccttggattaagctctatttagtcagctgctcgtgccataatggcaataggattatcagctaagtgagggaaaggctcatgggctgggataaggccatccagggggagcctgaataacagtctatcagaggggcatgggtctgaatgggagagagggagggccagcttctgaaagtagaagtagacaccccggcagggagcctagggggatagggatgggagggcaggaggcaaaatcacctctttgagcctctggtttgccactggtgtaaaataagatagaaaaactaacataaaacattacacaaattcttattcctggactaacccctgcactataggaattgttcataccttagtcgtccacttgtcaaaacttttggaatgttcagaaggcccaggttgcagtagtctgaggatctcactttcagattttcgtgttttgatgtcggattcatttcccacattccgaagcgtcctatagcggctgaagatgactaaatgatctaaatgatcatgatcatcccatccctccctttccttttccagaaaaagaaaaccgttagattttggtgttttttgtgctttcttggtttttctttcttttttttttttttttttttttttttgagatggagtctcgctctgtcccccaagctggagtgcagtagcgcaatcttggctcactgcaacctccacctcccgggttcaagcaattctcctgcctcagcttcccaagtaggtgacattacaggcacctgccaccacactcggctaacttttgtatttttagtagagacggggtttcaccatgctgaccaggctggtctggaactcctgacctcatgatccacccgcctcggcctcccaaagtgctgggattacaggcgtgagccaccgcgcctggctagattttggtttttaataaaagtaatacaaccatgtcttcaaaaattctgcatgataggagaggcaagcatctctttttttcccctccttattcttcagaaatgaaaagcagactccagagaggttaagtcatctctccaaggacacacagccagtaaatcccaagctaagaaaaaagcctgggtctcctgatttgcagcccagacttctgtctgcaccaccttaccctttccatcctggaggcctgtggcatctgcacaaagttttacttacctctcccaagtccaaaagaagggatgacccagcaggtcactcagacagtccctcacatgttccccaggatggaagagacgatgaatgaggtccttagtttcctcatctggagaaagttgaaccacctcttcattactttgagctttcagatcctcaaatgagatgcttcccttctttaccacatagaggaccagccgtccaaggtcctgcacaaaagccataaatcaagccaaagatgcttactaattatttgggtaaccctggaaggagtggtgcacgctattagcaaacaagatgatgggaggaatctcaaggaatttgtaggcttgttagggagggaaggcacagatgtgtgcatacagacctcttcaaggcagtatatcgcccataccacttagttttatgaagagtaaaagatacatataagtcacagttgttagggcagactgcttggaggaagagagatttgagctgggcctcaaatgtatggacagaatatagataaattgaggaaagggagaatgctttaaacacagggagaactgacagcctggctggaaactgggactttgggtctgaggctatgtcacgcagcaaataaaaaagtcagtccaggccaggagaggcaaagtgatgaccccagggattaggccgtggccaggaggaaaggccaagaagaaggtcgcctaaggaactctttgcactagccaccagtcaaggagggagctgaaatctgatgccaccaaaccaggaggccagacatatgggtggagagtctcacccactgggttgaaagtgcagcaccctgtaaaactctccaggaaagacctaccctgacagggtcagaatcagcctgggggctttggtctacagcggccaatctccatgtcccctcaggagcaacagctatttcagagtcctcatctttttggccaagcttaggttctttcaagctgggaattgacctcactcctcccaggagttttcagagaaccttagtatccagccttctgcagagtgtagcccacgagtttgagtttgtggtgaaagaaacctcacttactttgttcctaggtagaaaaataactcctcaatgaatattggagatatttgaaattctctcctggagagaagatgtggcatgctcagtttatttacttattaaggtagtggaggaagagagattcaaagagatacagtaagggtccacagtgacagccaactccacaccgacccaagctgttgcaccttcccattgtcatcttgaaagctctgctgcgggagaagcccaaggaaatgccatggcctacaggggagtcaggacagtgagcaagatggggaaagccttgaacattctttttttcctggttaaaatagaatgccctccaattgcccataggaaataaggtaatgaactgtgacggttaatattgagtgtcaacttgattgagttgaaggatacaaagtattgtgactgggtgtgtctgtgagggtgttgccgaaggagagcaacatttgagtcagtggactgggagaggcagacccacattcagtcacggtgggcaccatctaatcagctgccagcatggctaaaataaagcaggcagaaaatgaaagagcagacaacttgctaagacttctggccttcatctttctcccgtgctggatgcttcctgccctcaaacatcagtatccaagttcttcagcttatggagttttggacttacaccagtggtttgccaggggctttcaggcctttggccacagactgaaggctgcactgtcggcttccctacttttgaggttttggtactcagactgacccatcactggcttccttgttcctcaacttgcagatggcttattatgggactttatgttgtgaccgtgtgagtcaattctccttaataaactccctttcatatatacatatgtcctactagttctgtccctctagagaaccctgactactacatgaaagaataaggaagcagaaagaagaaaggtaaactggattgtagaatttacctctagatctctcttgacttcctgtggatctccagcccacttgatgctcttatcaaaatctgccaggtgagcagctttcttagaatctaaggaaaagtttgcagaggcacattgaaaatactcattctccataaagtgagagtcaattgatttatataaatatgtaacatgctataaaaatcatcatctctgtggaaggcaataataaaccttatatctgtatttgccattcacccctcaaaacactgccatgtgcactgtttcatttgatctgttaggtatctgccaagagcagcacttacattttattttttccaggccagggggtaggaagggatgaggacaaatttaaccagctcctcgttcatgcaattccaggggccgaaagcacagatttgtaaaggagctgttcccttacactgagcttaaatctcagtgcatgtctatggataaggtatgtactctgcttagacctttcaggcaagaacagcctttcctgagcacctatgatgtaccaaatgacttactatttcatcattgcacttagacctcataacaaacttacgaaggaggcattatcagcctcaagtgaggaactgaggctcacagtatcaagtgacttgtctgaggttacaaaactacaaactagtgagactaggcttcaagccaccctaatcatcgctgaagccctggcttgctcccccgcaccatattgcttcctgggactttacggtcagccttgcttttcttttaacatttaaaagaaaatgctattttccttccctttgtttggcttggactagtggattctgacttgttctgccttggagtctgtgtcttcactacgtcacatcttgtcctgacatcctcaactttgacctcaattttgtcagtaagtttcatggttactgccaccttgtctgaaggaactcacctctaggattctcagatttctggagctactttgatccatgacatgccttcatctgtttattttgccaatggcaatctaaggctagcctggtattctgttggcatctaccaaccttcatgtagactaacagaacccagttataattggtagcaggagacactgcactgtaattatgaatttgttgtaataatgatccacaaattgaatcatccacatttactctaggcctttcctctctgcaatgaaaaacttttcctatcataaacaaagatcccacaatttctaagagagaattggggattggggactcacctattaagatgttttgtggttgcagatcctggtgggtgtatccacaggacaagtgtagttcttgaacagccttaaatatagatgacaggacatttcgggcaaattcatcttcctcattttccacatcttcccctctgtgcacatccaaacacgcttccagagtctgctcacagagggtgacacacacaaacaagtggcccctgtggctctcactcccatagaatgtcaccaagtgactgttctctcggctgctttgcagacaagagacttcccgctgtgcacgtgggctgccctcacagaacgtcttcacagctacttcttgcttctcatagaaccccaggtagatgcctccttctgaagtatcagcaattttgtatttttcatcaataaagaacttgagtttgccaatcatagggcggtatattctgtggagatccttcagggctgccccccagtgtgagctctgaggcttccagtcttcagcaggagggtgaaaatcttctttggctccatgagagagaagaaccttcacaagggaatggtcataattccgcctcgctgtcataacaagatccccacaatctgtactggctccacgtttgcacagcaactcggcgattttcttcagtttgagttcaacagcaagcagcagtgctgttttgccatcactgtctgtgtcattaatctctatgtgctcttgctccagaagcctctgcaccaaacccaagtgcttcttctccactgccaggatcaggggagtcttccctctttctcccctcacattgacatcagccccatggtccagcagcagatgcgtaatagcctccacatcactatcgtcagagctcaggagagcatggatcaaggcatttctgcccatattgtcacaggcgtttacatctgcccccatctcatcaaggagaatcttcaagacctctacgtgtcctttttcagcagcgtccatgagagctgtggcccctcctttcctcagccgctcttgatcctcctttgtctttcgcctcaaattcacatttgctcctctcttataaaggaattttagggctttgaccttaccatacacagcggcttccatgaaggctgtgaagccataaaaatcacactcattgacatctgctcctttagaaaggaaaagtttcagcagcttcacgctccccgcaatcgctgcgaggataaaaggcgtggccccattcttcttcctcagaacagggtcagcaccatgacgaagcagaagttccacaatgtcctccctgctcatttgtactgcgttatgcagaggtgtccagcccccttcctcttcctggaaattaacattggctccaccttccagcaattgctggaccaggtcaacatcttcgttttgaacagctttaatcagcaagtgattgtcttccactgcagcccttctaccgctggaggacgtgggtccctcctgggggttgttatgatccctgctctccatgacggtaaatgccacctgctaccacttttagccttttccttgagaaaatgcaaatttatctcctagcacttaatcaaagaagctttgagtgtaaattgggattctctggcaacagagcagcagtatgaagaaggaacaatgttctcagtcttctgacattccacctggcaacgaagagaggtgctttgtaattttacaatagggagaaaacacttgaatcagagaaattaattatattagcattttttctaaatacatatatttatttcttataaaacttttaaattacagaatattataaatatatgtaaattcaaaataagaaaattatttctctagtcccaatgcccagaaacagccaatgttaatattttagtgtatttctatatattttttaagacatttggaattatactctgtaagtaactgtatcctacttcctttcatttaataccatactataagtcatttcctgtgttattgcaaagtcttgtaaaacatttttcatgactatgtaatatgaaatcatacagttgtttcatttctctattactgagtggttttcaaaaataagttttaaagggttttttaaaattaaaaatttaaaaaatctaaatgatgttgcagcaaattcagcttattttagtttattttctttcgatagatcttatgatagatttcatatgatagacttcaaagaatttaatgactattcaaaagatatgattgtatttaggattcttaacctatattaacaaattgctttcaatgtcatataaatatattcttaccagagataggtggcttccaaaaaaaaaaaaaaaagaccatgaaaatatgcacatcaattatttatcaataaaaaaagaagaaccctcattcaataagaaaaatatatttcttggctttttttccctttgcatttcttatgtcaccaggaaggttgatcactgtgtttgctgactctgtgcatgtcctctttgtacaaccctgtgcccctatttaaagtacagacaatatctgacttatgttttttgactttgatttatgattttttgactttgcagtggtggaaaagcaataaacattcagtagaaaccacacttcaagtacacatacaaccattctgttttttatttcagcatagcattcgataaatacatgagacatttaacactttattataaaataagctttgagctagatgattttgcccaactgtagcctaatgtaagtgttctgagcacatttaaggtaagctaggataagctatgacgttcagtagattaggtgtattaaatgtgcttttgacctacaatattttcaatttaggatgggtttatctgtatgtaaccccatcataagtcaaggagtatctgcagtagtgaaaagagcttgtactctgaccttagggagatctaagtttgagcttgtggctgtgtaattttttactattacttcctgtaaccttggattgttgaatctcaattttctatttcctgaaatggagacaaaaataaatacagtcatgtgtgtaaagtacattaaagtatggagtgttgcaaatattagccactcaatgaatgttagagctaattatatcccgttatgaaaaaataaattgcttagtgaattctattctccctacacatgtgcatatagctactacacgaataggcaactggcagctatcaatttcgtccaactgtcaatcagatctgagaattacagatccagttcaatcatcagacagcccgaaactgttacctgaatatttaaataactgcatctgctatagaattcacgaagcaaccctttttcagcaatctcaccactctgacagtttcaaagcctcagaggttaattgattagcctcttagaagtttaattaattgtgcaacacatacacgatcaccaggcaatgaaatctttgaaccaaagtgtttgtgtagaccgtccccattacaatcagatgtgaggtgggctggtataaacaaaggagccgggaaggagaggaaatatcaaggaagccctgagtgacgcatcagagtagagaagagacgagcctgcggaagtactccaacagacaatcctgctttcaatttcactttctctgtgcgacctgagtaagtcgcaaagagatgcctgagaaactgaggacatggataaatgacgtgtggactctgacagaactctggaagggcactggaggaagatccttccgggcagccaagggctgggagctcccctcccacttcccaagtcctccagcccctggcctctccagtctccaaagcccaagaattcttcaggatcgacttatcgaggttttctagctttcctccttctgcctgccttacctgctcaactcagacgtctcaattattcctttggcagccgcaaagcctggaagactgcttgcagcccgagcagtttcctcctgctgcgtcact

SEQ ID NO: 1960 - DNA, 34983 bp, Homo sapiens
ttatttttagtattttatttttcagattctcagcctctgcacagccttagtactccctgagaaattcagtgtttgcatatcctttccacaaaaatgagaggaaaaaggaccagtacctgctagtgactgatacatttattagtttctaacaaaaaggcatacatggtaggcagagtagaaatactaacagaaattagtttatcttgaaaccaattttagtcaggaagacttcttcacagagaatgagctgaatatataaatcccaaatatatcacaccatatatgtgatatatttacacctaaatatatcacaccctcctttttggtcacagactattccaggaagattaaatagataacgtttaatttgaggcattcaagaatgtccaccctaaaactgaaagtgaaattgctcttagagaaaaattggtttgatgagaagattgatcttagcctgtctcagacaaatttggtttatttatttttacttaacgacccatgtgatagtatagttgcaagctatacttcatttaactacaatcattactcagaggacaatcaccttaagaggcaaattaagttttaaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttctatttctgttcataaactcaaataaaagcagtatcaacacaaatgatcatataagaaaacacgtggttatgtttcaggttccacaacataagacactgtgaggtaactctcctgtaatacattcccatttttttctggaatagcagatgcatagaaatgcaggtttccaaaaattcacccaatttagtaactaattttgattctgatgcctgatagtagggtgtgaaaagctgtaaaacccaaatgtttcctgtgttctttcacaaggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggaggcggaggttgcagtgagctgagatcgcgccattgcacaccagcctgcgtgacagagcaagactctgtctccaaaaaaaaaaaaaaaaaaaaaaaaaaaaaaaaatctgggatttcccacatatgaatatgaatccaaattttgaaactccgtctaaaaaaaaaaaacaaacaccaaaggaaatgctacaatgctgaaaattgaattaaattggagatggaaattagattactttaggaaaaccttttgagtactctgtaaacattggacaatagcaagaaaatggattttaaaccctgcatgggttccttaatcactcagaatagtataatcttgctttgattaccagtcacgacaaaaaggtgagcaaaggccataaaacatgcagtttttggaaagacaatggcacttgaagatttcctggagttggccaaagcttaagatatctctaagaattgtaaagcttaatacacatctgttattaagaagggaaacgacaggggacccctgcttaccgctgagctgtgcagaagctcatgtgtctatgcagtccttacaatcacacagaccttcattaaggacaatgagtgtgcctagagagcagcatgaatgacacatggatgaagattccatgataggaaagagcttcacattccagctttactagatcacaaagcactccctttaccaggccttactttgtgcatctctgaaacatctgaaaaacacttttctgtgaaatgctaggctgtagggagtgagcacttttggataccttacagtgatctctagtagaatttggcatctttcttctattaactgactgcttcaactgcatctttaaagacacttgcctatttttgtcccttgagcctctctctggtgttggatgctttgtgtgagtttgccttttgaagttcccatctttgggattcttcctctgtccatttagcactttgtctggaggggaggatgtagcgcgtaagtgatactcatctggggatcctttttgccggtttggcaccatttgctctttatccacctccttctgaagttgtaatgccaataacctgtcctgttcttcttgtttatgtctctcaaacagtagatgctccaaatctatcagtttttgggtaaagtttatttctgtttcctcttgatctggggaagattcgggggacacttttcttctttttgcagaaaagcatggatccttgactgcttcaaaggaagattcttggttttttcttttggaaatctccttactgatcagtaggcacgactcttcattttctgtctcacctgtgttgtttccatttgtctgtgtcacccctgatgtgggggcgcacccactttctgttctgccacaaggcataactgcagtttctttcgagtagggaactctggttttaggtcgctcgtgacttaagacacataactctttcccatgattgcttggtcttgttttgacgtttccttcatggtaccattcggcaccacaggcacataaccatggcataggggactctattgaagaatctgcaccttgttctccaactccaagggatatctgtggagaaagtgtcggcatatcttctatttctgtgtcttgccctgttgggcttttcctatcactactgtcaatgtcctgtagaaaacagaaaaagactgagtgaaccaggggaaaatatcaaatcataagatgtaagtctaattacactgatactacagctggactgtcactatacattattattactaataaggtatatatttctttctttcttttctttttttttcagagtcttgctctgtcgcccaggctggagtgcagtggcgcggtctcagctcactgcaaccttcacctcccaggttcaagtgattctcctgcctcagcctcccaaataggtgtatatttattcttaatagtatttttatttcatgggcaaatttagattaagctattacttcattttcactcccatgaaaacctacagattaaaacccacagactagattccaaatatggccaatagctggtatcaggacctgaccttctttcaccttacaaaggtctgccagcataggggtttttaactcttttctctaccgtggaccctccttttggcatttaggtgaagcttacagaccacttctgagaataatgtttttaactaaaaaattaagatatacagtagctttacaaaaggaacaatttatgttgtaaacacaatcattaaaaggttcaaaaaaatgtgaggtaataatgtgcatctataatacagtaaataataggatctaccagccagtctaataactcataatacccaattatctgtgtcacccctgatgtagtacacccactctctgttttgccacaaggcacaactgcagtctaataccaatgtagagataagtataaatgatatttaaagatatctgtaacatggctgggcacggtggctcatgcctgtaatcacagcacttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaaatacctagtgtttggaagataaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatttttttttttttttttttttgaggtggagtctcactctgtcatccaggctggagtgcaatggcgacatctcagctcactgcaacctccgccttccgggttcaagcaatactcctgcctcagcctcctgagtagcagggactacaggtatgtgccacacctggctaattttttttttttttttggtatttttagtagagatggggtttcaccacattggccaggctggtctcgaactcccaactttctgcctgcctcagcctctcaaagtgctaggattacaggcctgagccaccgtgcttggcctcccatcttgtaatattctttttttttttttttttgaaacagagtttcactcttgttgtccaggctggagggcaacggcacgatctcagctcaccgcaacctctacctcccgggttcaagcaattctcctgcctcagcctcccaagtagctgggattacaggcatgcgccaccacacccggctaattttgtatttttttgtagagatggggtttctccatgttggtcaggctgatctcgaacccctgacctcagataatccacctgcctcagtctcccaaagtgctgggattacaggcgtgagccaccgcattcagctccatcttgtaacattctaagtgaagctggtgccaggtataacctattcagttttgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaaggttgtctggtttgctgcttggctgttttatcagagtgtatctcatttccgtgcttcagatattttggtcaattccaggacaaaacttaaatgattgagtattgatattttagtgaaaaacagaaaaggaagtaaaagtcaaatctaaatattttttcttttttttttttttttgagatagagtctcgctctgtcacccaggctggagtgcagtggtgtgatctccgctcactgcaagctccgcctcccgagttcacgccattctcctgcctcagcctcccaagtagctgggactacaggcgcccaccaccacgcccggctaatattttgtatttttagtagagacgaggtttcaccgtgttagccaggatggtctcgatctcctgacctcgtgatccgcctgccttggcctcccaaagtgctgggattacaggcgtgagccactgagcccggctaaatatttttttttcttttcttttttttgagacggagtctccctctgtcgcccaggctggagtgcagtggcgcgatctcagctcactgcaacctccgcctcccgggtttaagcgatttttctgccttagcctcctgagtagctgggattacaggcgcccgccaccacgcccggctaatttttgtatttttagtagagacgggtttcaccatgttggtcaggctggtctcgaactcctgacgctcaggtgatccgcctgtctcagcctcccaaagtgctgggattacagccgtgagccactgcgcccagcgtaaatatttcttaattcttgaaaaaagcttaaaaaagcagatagcatcaaaacaatgcaagactctatagtcttcccaaaagtaatgaaaatgatgctttaaactaggagaaaggatatgttagtttcttctttatgctggaaatgttggctgttcacgacattttaaatctctactattgggaaaaagtccatgattaaattccttactattctggtatagagatgttatcatacatacttttatatcaactctcttcttttttttttttttctgagacggagtcttgctctgtcacccaggctggagtgcattggtgcaatctcggctcactgcaaccccgcctcccaggttcaagtgattctcctgcctcagcctcctgagtagttgggattacaggcatgtgccaccacgtccagctaatttttgtatttttagtagagacggggtttcaccatgttggccaggctggtctcgaagtcctgacctcaggtgatccgcctgcttcggcctcccaaagtgctgggataacatgcgtgagccaccgtgcctggccctcaactctcttcttagaaacacatatctttacatttctttctttttttttgagacagagtctcactctgtcgccaggctggagtgccgtgacatgatcttggctcactgcaacctccgcctcccgggttcaagtgattctcctgcctcagcctcctgagtagctgggactacaggcacacgccaccatgccctgctaatttttgtatttttaatagagacagggtttcaccacgttggcctggatggtctcaatctcttgacctcaggtgatccgcctgcctcggcctccctaagtgttgggattacaggcgtgagccactgcacctggtcatatctttacatttctaagaatcttcaatataacaggctgtttgccactgaaaacactacggttttaatagaatggaaaatgttataaaagaacggggaatagaaaaggcaggctacaagatggtaggtatagtttaaaaattgtaaaatatccaaacatgcatataactatgtttacaaatggcagaaatttcccaaaatgttggttgtctccaaatggtggaaactttgggtgattttcaaagagcagctagccatggcttttagaattagagaaaaaaagtgactataaataacagacaaatccataagttacactgtgtcaaaagcaccaacaagtagcatatggaacaatcaaacctaaacaaagatctcatataaagaactaatgaatattccttatgggcaaacaagagtacctaacccatatatttagttatatcaatctatatatttactctgttaactttgaagaacaagaaccaaattttcagttgaaaagaagcttagtctcatttagtttctttaggctgaagaattctttctgtcaatgctgatgcgggaccactacttacgaagcataccagtaccaaagtatcactgttataacagttgttttgacgttcataagcagagaacagaatgttattacttatccaacacaatcactgaagattcattaactctcttggatattccttatttataataaccaagtaatatatgaatacatgctcattctgaaaataagcagaactggccgtggtggttcatgcctgtaattctaacactttgggaggctgaggtgggaggatcgtttgaggccaggagtccgaaaactggacaacacagcaagacccatctctacaaaaaattaaaaagaaaaattagctggacataatggtgtgtgcctatagtcccagctactctgaaggctgaggtgggaggatcgcttgagcccaagagtttgaggctgcagtgagctattttcttgccactgtggcctgggtaacagtgagaccctgtctcttaaacaaaacagaaatacaggaaatatatgtcatcaaccctttcccttcccatgttttaagaacttttttttttcttttttccttgagtctgaatttttgggatccattcccatttgcttccttttatgttttaaattaagtttagcctaaagctgcctccttacgtattttaagttcagcccaaagatttctctgtatatagtgaactacagcctaaagggaggtgtgaacagcctgtaaactactcttgtgccagtcaccaagctttggccaaagggggccaactgttcaaatcatgttcaaataaggcaaatgccaaactgtaaccactctggctgtctctgcccctcatttctgctttccatacatcacgttcccttttctgtctgttaatcttcttccgacatgtggctccacgggagtcgctctcggcctactctggctcgagaggctgcccaatttgtgaattgtcctttgctcaattaaactctgttaatttgtctaaggttctccttttaacatatgtaaccaattttttaaaaatatgatttctatgaaatacacactctttttgattttgtttattttagttattttattttttgggggacagagtctcactctatcgcccagactgaagtacaatggcacaatctctgctcactgcaacctctgcctcccgggtttaagcaactctcctgcctcagcctcccaagtagctgggattacaggcatgcaccaccatgcccagcgaatttttgtatttttggtagagacaggctgatctcgaatgcctgacctcagaagtattgtatttttggtagagacaggacagccaggctggtcttgaactcctgacctcaggtgatccacccacctcggcttcccaaagtgttaggattacaggtgtgagccaccgcacctggccattattttatttatttttttttgagacggcgtctcactctattgcccaggttggagtgcagtggtgcagtctcagctcactgcaacctccacctcctgagttttaagcaattctctctgcctcagcctcccgagtagctgggattacaggtgctcgccaccacacccggctaatttttgtatttttagtagagatggggtttcgccatgttggccaggctggtcttgaactcctgacctcaggtgatccacccgcctcggcctcccaaagtgctgggattacaggtgtgagccaccgtgcctggcttcattattttttaaggcagggtcttgctgtcaccaaggctgaagtgcagtagcaccatcatagctcacggcagccttgacctcccaggttcacgtgatcctgccacctcagcctcccaaacatctgagaccacaggcacaccacgcccggctaatttttgttattttttgtagagacagggtttccgcatgttgcccaggctggtctcaaactcctaggctcaagtgatccacctgccttggcctcccaaagtgctgggattgcaggtatgagccaacacacccagcctcacgcttttttttttgagacggactatcgcccaggctggagtgcagtggtgtgacctcggctcactgcaacctccgcctcccaggttcaagcaattctcctggctcagcctccccagtagcgggattacaggcgtccgccaccacgcctggctaatttttttgtatttttagtagaaacggggtttcaccatgttggccaggctggttttgaactcctgacctcaagtgatctgcctgcctcaccctcccaaagtgctaggattacacgcataagctactgcgcccggcttgtgatttgcttttttcactaatgtcttaagatctttccaagtctgcctcatgaaaacaaagtttatgagagaacagtcatacaatacatgtaagaatcacagtacagcacggtcacggggagggggacactgactggaaagggaaagggcacaagcaaacctttgtaaatattccgtcttcatctggtgggtggtttatacacacacaaaaattcaccagaaagtatacttaggattggtgcaccgtctttttaaattttttactttttcttttttaccctgtcttatggtgccgaagactggtgcactttaaaatatatgtttgctgctctgtggtccattaaaaacaaaacaaaaaaatgtgttattcttctaaaaagtttaaaaatctgtattaccatgaaagcccatatgcttattacttggttgaagggaaaagaaatcattggtttgaaagtctcctatggggcctcgtcatctcccacctcatactatcctgagtttcttatatcttactttttaaaacagatttgccacacttttgcatctctaaacactttattgattagtattgtgtgattctgagcgagactccgtctcaaaagaaaaatttgaaaagttggaattctgattcgaattgcactgactctatagatcagtctgaggagatctgaccattttgtagtattaggcatcttctaacccatgaatattgtatatttaatataatacaattttctccacgggtcgtacagatttttatttttctgagacatggtcttgtctgttgcccaggctggagtgcagtggtaaaatcacagctcactgcagccgtaacctcccaggctcaagtgatcctcctgcctcagccacctgagcagctgggactacaggtgtgcatcatcatgcctggttaattttttaatttttttttaagagatagggtctccctgtgcagctcgggctcgtcttgaactcctgggctcaagcaatcctctcgcctcagtctcccgaagtgctgggattataggcatgagccaccatgcttgcctcagattttaacacatttatttttaagtacttttattttctgatactactatcgacagagtatttttaaagttacattttacaattgactttttgtacagattttatatctggcaaccttgctaaactcttcattctaaaaatgtacctctgactttttgggttttctacatagataattataccgcctctgaagaatgatagctgctttttccttcctttccaggctgatatgttttatctccttttattgtgttactgtgcagactaaactctccagcatgagtctgaatgcaggtggagagtagcaggccacccttgcgtattcctgaccttacaaggggaatggcggggcgtggcggctcactcctgtaatccaggcaccttgggaggcccaggcgggaggatcacttgtacccaggagtttgaggttgcagtgggccatgatcgcaccactgcgctctagcctgggtgacagggcaagaaagactgtctggaaaaaaaaaaaaaggaaataatttcgatgttccactatgaagtatgatatgtgatgtaagattttggtagatatccttcaacaggttaagaaagtttctttctgttaccacttcattaagaattatcatctcgtgtatttcatatttatacagctaattgaataacttacagtgattcattttctaccattaaaccagcaatgtattcctggaattgtctttttaaatacgttttcagctgcgtttttttttttttttttttttttttttgagatatgatcatagctcactgcagcttcgacctcttgggctcaagcaattctcccacctcagcctcccaagtggctggggttacaggcatgtgccactgcatttggctaatttttttattttgtgtagagacagggtcttactatgttgcccaggctggtcttgaactcctcctggcctcaagcaatcctaccacctcagacctcagcctcccaaagtgctgggattataggcatgagccactgtccctggcttttttttttttttttttttagagacaggatcttgctatgctgtccaagctggtcccaaactcaaactccctgggcttaagcaatcctcctgcctcagcctcccatgtagctgggattacaggtacgtgccacaacacctggctgccctttcttcttttctgatacggcacgtaaagccttctaaataccactttagccacataccagttttcatgcatattttcagttctgtatttccaacaaaatttactctttaatcaacaagttgtttagaaatttttcttaattttaaaactatataatcctgttattcatttttaaacttttgaattgaggtgtaattcacataaaatggaatgccacattttgtttacccattcatttgttaatggacatttgggttgtttctacctttcggttatttgaataatgttgacacaaatattcatgtacaagtatttgtttgaatacctgctttcaattcttttgggtacatacctaggagtggaattgctgggtcatatgctaattccgtttaacttttcaaggaatcaccaactgttttctgcagccacgataccactttacattcctaccaagcaatgcgcaaggattccaatttctccacatctttgtcaacacttattattttccctttttgtggattatagccatcctaatgggtatgaaatgctatatcactgtggttttgatatgcatttccctaataactaatgatgttaaacatattttcgtgtacttattggccacttgtacatcatgggaaaaatgtctactcaagtccctttgtccagtttttaattatttgtcttctgttgttgagttataagagttttcatatattctagaaaacagactttatctgtttttaatattgttacaactttaatccatcagtttctcaatttttgcttttaaatccttagtttttcttgtatctctggtaattttttatttttatgtatttcaaagtatatatttagatatataaagattcatgagttatagccttaaacagcatattgtatcaatatgaaatacttctgcattttagcggttttctcatttttactttgcacattatgagtactggcgacactgatattgtcacatctttttttttttttaatagtacctccctcatttaacattctcttctcctaagcttcctcccacctcaaatacaaaatttcaacaaatcttggaaggagatgagttacctgcacatatttcctcagttgaaccagaagtccttatgtatttttcaagtctagactgtggtttttaaacttttccaactgtgagttaccatgggaaagctgatgtttgcgtaaagccaccaactccacctggcacctgaccctggaggggtgttgtggtgaaactcaatcacgccacctttgtctacctgactcatgcattttgtgtaatagagaagaaatgacaaattgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtgtgagtagctctctccttttcaatttacctcaacctcagactattttcatacaaagttcacggaccaaactttgagaatcagtagtagtctatatgaacagaaaacactggcatacagtaggaggtcaacaaataattcatagtcatgttcacttacttctgaatatctccagtgtttctttgtttgttcttacttttcttttcagacttgggtgtaactggatcagattttctggaattcaagggagaagccgagatacttccctcacagaaattgttcttcaacaatagaaaaagcataacagacattatgagagagaactttatgataaaataagctattaatttgactaattcagaaatccatagcatttttcagaaattatagttatatttaaattctgtacatctcttgaagaatattgaccatgcaaaaatcagaataaactatgttcatccaagttggtctaaattaattacatttttactgtacatcaagcacaaaataaggcataatactaacctcattagctgataattcctgttgatctttctttcctttttttttttttttttgagacgcagtctcgctctgttgcccaggctggagtgcagtggcgcgatctcggctcactgcaagctccacccccgcaggttcatgccattctcctgcctcagcctcctgagtagctgggactaccggcgccctccaccatgcccggctaattttttgtattttttttagtagagatggggtttcactgtgttagccaggatggtctcgatttcctgacctcatgatctgcctgcctcggcctcccaaagtgctgggattacaggcatgaggcaccgcgcccggccttttttttttttttttttttttttttaagacagggtctcactctgtcgccgaggctggagtgcagtgtagcaatcatggctccttgcaaccttgacctcccaggttcaagtgatcctcccaccttcacctcccaagtagctaggactacaggcatgagccaccaggcttggttaggtgggttgtttttgttttattttgagacagagtcttgctctgtcatccaggctggactgcagtggagtgatcatagctcactgtagcctcaacctcctgggctcaggcaatcctcccatcttagcttctcgagtagctaggacacaggcatgtgccaccatgcccagctacttttttttaaatgctttgtaaagatgaggtctcactatgttgcccaggctggtctccaactattggaatcaagtgattcccccaccacagccttccaaagtgttcggattataggtctgtgccactgtgcccagcctgttgatttttctaataaatacttttatataattacttttatctatatggacatattcagagagctgtggatatacccaaaagaatagttttatgtaataatattttagttctggactttaagggcgtattaataaaaatcacaaatatttacttgctgtaccagtctcgtaagtttcttactaccctaatggaaaagttcatatatggtgatggtgaatatttggccttaaaccaccaaactttcataaataaatagaaaattattctaggttgggcatggtggttcatgcctgtaatcccagcactttgggaggctgaggtgggtggatcacatgaggccaggagttcaagaccagcctggccaacatggtgaaaccccatcggcactaaaaatacaaaaattaacaggatgtggtggcggcacctgtaatcccagatactctggaggctgaggcaggagcatcgcttgaaccgggagttgaggttgcactactgcactccagcctgggtgacagagtgagactcttgtctcaaaaaaaaaaaaagttaaaaaaattattctacagtatcaataaatctactcttataataccatgggaaaactagatatacttcttccctattccatttattattccattggtcaatgacttttatttagtttcctgattgtgtatttctaaagcgattctacttaaaaaagacacataaaaaggggcatataacccaaaatttgggtacattattattaatggtaggcctctcaaaaaagaaaaaaattcccaattctgcgtatactcattttgctaagtgtatatacatatatatttttttattctattgaacttcccatgattcaatggtaagtgtatgttaagatattcgttgtttgaaagctgaagaattgttttcacaggctctcaaacctgaatgtttcacacttccctacatgcctctgaagattgtattccctaggtcccatccctagagactctgacttaatagatttggagtaaatatgagagtttgtatttcaacagcattcccaggttactctgccaggctcgttcaaaccactgggccccacagtaccctctgatcttaaagtatgtgttttatcacacaccatttaattcattttcttacaggcagcaatttaactacaggaagcagaacatccaagtttaatacattatctaaaaatttaatgtgccttactttcaaaatgtgatttacatccataaaatggaatattattccactctttaaaagaattagattgactacatgtagtaatatgaaaaatctctacgatgttatcaagtggaaaaaatgtaagcagcaaaacagtgtgattgctttatataatcctttttaggtcaataaagaaaaaaagcttttttttttgagatggtcttccaggttgaagtgcagtggcgagatcagctcactgtaacctcaaactcctgggctcaagggatcctcctgcctcagcccctcccagcaggtggagctccaggcacgcaccatcacactcggctcattattaatttttctgaagaaacagggtctcactttgttgcccaggctggtctcaaactcctgggctcaagcgatcctctcgcctcagcttcccaatgtactgggattacaggcccgagccatcgcaccctggcaagaaaaaagttgtaagaaactgttaatagtggttacctttggggatagagactgatataaatggaaaaggaacgggagtggagaggtggaagaaggaaaaaggaagctttcattcttcactgaatagctttcctacatataaaaaagttgttaaacaacttgcggtggctcacgccacaaacccagcactttgagacgccgaggcagatggacggcttgagcccaggagctcgacaccagttcaggaaacatggcaaagccctgtctccacaaaaaagtagccaggcatggtagtgccagcctgtagtcccagctactcgggaggttggaaggatcaccggagcccggccgtcgaggctgcagtgagtcgtgattgtgccactgcactccaacctgcatgacagagtaagacctgtctcaaaaaacaaaaaaccccaaaaacctggattagagcaaatatgtaacaatatgcaaaacaattttactttaagtaaagcaaaaatgttatcaatagcttctaattatggcaacgccatctcttctgttctttgaaaaccacagtcaaagcaatcggaatgttaatagttagctttccgtatcagcaggttccaaacactcaaatccaaccagcctggggtggaaaagacaatatttgtgggatgcagaacctggaaatacaaggagctgactcttcccatgagcgggttctgcagcagcgcataccaagggatgaccataccttagcgttccctcctaaaacttacaatatcaatgcttagctttcttgccagttcctcatcacttttcagttgttcttccatcgctcttcgccttttttctgcctgtcttttttcctcttcttcctcctctgccaacaacctctgtatgtattcttcactggctttgttttcttcttcctcgctggcccgtcgctctgccgccaccttaaaagtgattaataaagagcaatccttctctgaacgttttggtatacttgcaatatttcataacaagaatagaaaagtagaaaaagaacaaattggcagaaatttaaatgatctcaaatgaagtacaaatctggagaagtagattcctgcaagatagctgtcccatctcagcctcccaaagcactgaaattataggtgtgagcctccacacctagcctgagatgtattacaagtgaaaattatacacaaaattttgaagactaacaaaaaaagagaaaaatctctatttatgtataacttcatatgtaattaaaacataatgcttcactataaacactgctttttaggtacttttcctatttaggaacttcacagctagccctttaacctttcctcatctaaactcacactctaccacccttttactttaagctcaaaactttggggaaataaaaatatatcctggtatggattaaattaggaaaaagaagaattaaaaaattttcttcatatgtaaatgcttagggaacactatcacataagagcattaattatgtagaagtaaattacagcaaaaaacaaagcccttataaagtacattaaaattatccatattttggccaggcacagtggctcacacctataatcccagcactttgggaggccgaggcgggcggatcacaaggtcaggagatcgagaccatcctggtgaacactgtgaaaccccatctctactaaaaatacaaaaaaattagccaggcgtagtggcgggcgcctgtagtcccagctactcgggaggctgaggcaggagaatggcatgaacccgggaggtggaggttgcagtgagccgagattgcgccactgcactccagcctgggtgacagagtgagactccatctcaaaaaaaaaaaattatccatatttcaagatatactagttatataagcacaaaaaactaaattaaaatctgaaactaaaaacacagcagagaaatattccaaaaaaaaaaactatttagcacctaccttgcttatttcctcttcatattctcttctcagttccccaggtttactgagcagacgaactggctgatagtcatcagctatttcatatcaaaaaagaaaataacattataggcaacacaattttatggtaactttggtcttccattaaaacgaaaaattaaaatatacaactattaataactgcagcaatatctccttttggaattccatttttaacatttattttatttatttattttagatttattttatttattttttttgagacagagccttgctctgctgcccaggctggagtgcagtggcacagtctcggctcactgcaacctccacctcccaggttcaagcgattctcctgcctcagccttctcctgagcagctgggattacaggcatgcgccaccacacccagctaattttttatatttttggtagagtcagggtttcaccacattggccaggctggtctcgagctcctgacctcaagtgatccacccgccttggcctcccaaagtgctgcgattacaggtgtgagccaccacgcccggcctggaattccattttgtgaggccagaggtttagggttttgggtttgaaatggcatatgaatgcatatacttaacccttcctctaaactccattaaaataacagtaaaggaatttttaaaaactgtaatcctacaacagcagaaattagcagaggaggttaactgattaaaaaaaaatgttttttttttttgagacagagtcttgctctgtcacccaggctggagtgcagtggtgcaatctcagctcactgcaacctccgcctcccgggttcaaacaattattgtgcctcagtgtcctgagtagctgggatcacaggcatgcccaaccatgcccagctaatttttgtatttttaatacagaccggtttttgccatgttggccaggctggtttcgaactcctaatgtcgggcaatctgctcacctcagcctcccaaagtgctgggactacaggcgtgagccaccgtgcccggctccagttaaaaaatttttaacaaatttctagaaaatgggaaggcaatgaaatagagataattgatacagcagaaatgaaggaaaagaaatccttgaaagggaagactacagctgaggtagaattagaagggaatctgcctcctatttgcctagagagaggctcatagagtccagagtgagtaaccgtgggactgaaaacagaactcgagatttataagctgttaaatcagaatcctcgacttaccggcatttctccctggatatgggtgcaggtgcacacacgcatatttctttaaagaaacagatctagagagagccagagcagctaatgtaataggtggtgacccagagcaaagtcctctgcgatcgggcagttagggatggcaaagcacaaaggccaggtttccatcggcttgaactcaacgtctgcccatcaccaatacccttccacatacacagagcttttctcctgggcctcattctcaaacctaaaagctaatccaaggatcgtcagacatttgaaatacatctgcaggactagggaaacagtaagctatacaaagagaaaaaatcatcaccctggagttgaaagataattctgggtcagaaaataacctaaatgtgggtatgtatcctcaacaaatctgatgagaattttattctataaaacaagacactgttttataaagtgtaaaaagggaacatccaaaaaagagaacgcatctgtctgtttcaaggggcagctgctactcaactccagctgactacgactaccaggaaactcaggcctgtccgtgccatattttttgctttctcaagaaaatccagaggcggcaggggtggatggtgagagatgacttcatgggtacaatgtacattatttgggtagcagataccctaaagagccctgacttcgccactgtgcaatctatacatgtaacaaaattacccttgcaccccataaatttatccaagtaaaaagaaaaaaaaaaagaaaatccagcaatcaagatgttaatatgaaatcttccaacttaaatagtggcattggatgggtcacaaaaaacatgcacacaggattcctatggcctgcaggccagcagtttgaaaaatctgcaacagagagactaaaaaacagtgatgtaactccaaaacaattagggatgcagtatgctgaattctcatttattttagtcactaaggaggatctattcaagacaatacaatggtatacacaggagagacatatataaggctccttaaaaagtagaaggataatcagctggcttaaactgagacctagatcagcaagtcttaaagtagaatctacgaaaccctggaggtatctgagactttttttcagggaaactgcagagtcaaactattttcatttaaaaaattaaagtaagctgggagcggtggctcacgcctgtaatcccagcactttgggaggctgaggcaggcggatcatgaggtcaggagttcgagaccagcctggccaatatggtgaaaccccgtctatactaagaatacaaaaattagccaggcgtggtggcacgcacctgtagtctcagctactcgggaggctgaggcagtagaatagcttgaacccgggaggcggaggctgcagtgagccgacattgcaccactacactccagcctggacgacagagggagattccgtctcaaaacaaacaaacaaagaaacaaacaaaaaacccaaataaaacaactgacagtaggccgggcacagtggctcatgcctgtaatcacagcattttgggaggccgaggcaggtggatcacttgaggtcaagagtttgagaccagcctgaccaacacggtgaaacccgtctctaccaaaaaatacaaaaagccgggagtggtggcaggcacctgtaattccaactactcgagaggctgacacagaagaattgcttgaacccgggaggcggagcttgcagtgagccgagatcacgccactgcactccagcctgggcgacagagggaggctccgtctcacaaacaaacaaaaacacatgttcaacattactagtcattagggaagtgcaaatcctgagtacggagataccgcttcagaggacagccaacacttggttttttttttataatagtcatccattaagatatatacacacacataatggagtatgcggccaaaaaaggaaatggaatggacacgtgctagaacacgatggaccttcaagacactacgctgcgtgaaacagccagtcaccaaaggacagacactgtgtggggttccactcgtacgagacacctagagcaattaaacccgtagaggcagaaagaatggaggtcgccagcagccaggggaggggtgaatggggaattaattattgtttaatgggcagtttcaagcgtggaagatgagaaagttcagagatgaatggtggtgacggctgcacaaaaacatgaatgtacttcatgtcacgcaactgtccatttaaaaatggttaacatggcggattttatgttatgtatcttttacaataaaactggaaaaaaagtaaatcactttacacattagatacaataaaatagtagctaagaggctgggcacagtggctcatgcctgtaatcccagcactttggaaggctgaggcaggaggaccacttgagctcaggctatcaagaccagcctgggcaacatagcaagaccccatctttgttcaaaaaaattttttttaagtagctaatttaggaaaacaataataagacagatgtattatactagaaagcaaaacatatcattaagcagaattaaactaagcatgtgtggtactgacacagctactgataaagagatagttaaaaaataaaaagcccaggcaaggtgccatggctcatgcctgtaatcccggcactttgggaggtggaggcaggcggatcacttgaggtcaggagttcaaaaccagcctggccaacaaggcaaataaccctatgtctactaaaaatacaaaaattagccacgtgtggtggtgcacgcctgtaatcccagctactcaagaggctgagacaggagaatcgcttgaacccgagaggcagaggttgcagtgagccaagatcgcaccattgcactccagcctgggtgacagagagagactccatctcaaataaataaataaataaataaataaaataaataaatagccccaaattgctctggaaaataagcatatgattagtgaaatagtacgtatatcaatgtggctgtattactaccaagtagtgtggctattaagtggcaatcaagggcagggggagttaagatgcctacctcatacaatactcgaattcaaggtggattaaaaaatggaaaaaaacaaaactataaacgactaagaagaacatatgagataaattccaaaacaattaaaacttccatgtgatgaaagacatcacaaagttaaaaacaaactagaagttatttgcaaatacataaatcaccagagaattagtgtccagaatataactagaacttccacagatcaattaaaaaccacaacaggcaaaggaaaggcacgtgcgatttacagaagatgcccaactacagcaagcagagagctgaacttttgttaaaccgtggaatgacagatttttaaagtttacttatttctacataaactgaatctaaattaagatcagtgagttattcaactgcagacacaagttaaaattgtcttcatttgcctttttcttttgtttttggaaacaagatctcactcttgcccaggctggagttcagtggcgggatcatagctcactgcagcctccaaccccttggctgaagcgattctcctgccctagcctcctgaagcactgggataacaggtgtgagccactgcatccagtccatttgctatttctttttcttctttgacggagtttcgctcttgttgcccaggctggagtacaatggcgcaatctcaggtaactgcagcctccacctcccgggttcaagcaattctcctgcctcagcctcctgagtagctgggattacaggcatgtcccaccacgcccagctaattttttgtaattttagtagagacgggggttttaccatgttggccaggctggtcttgaactcctgacctcaggtgatccacctgccttccaaagtgccaggattacaggtgtgagccaccgtgcccagccttccatttgctatttctttctttttttaaatttatttttttttttttttgagacagagtctcactttgtcactcaggctgcagtgcagtggtgcaatctcagctcactgcagtgtccacctcccaggctcaagcaatgctactgcctgagcctcccatgtagctgagactacaggcgcccaccaccacacccggctaatttttgtattttttgtagacggttttgccctattggccaggctggtctcacactctcaggctcaagcgatttgcctgccttgaactctcaagtactgagattacaggtgtgagcccccgcacctggcctgtttgctatttcttaaacaactctaattttataagaaatttgaatatctcagttttatagtcttaaagtgactatacaatttttgccatctgttggaaacaactctcgacactcttcagttctggttaactctaaaatttctgctgaaacccacttcggttaaacattcctactctactcgatattttgcttcttcgcagcaagtggtcttcctaggcggccaggactcatttaaggaaatatgtccccatgctttttattttattttgaaggaaaaattcaagttagttaaagacctgaatgtataatactggatgaaaaataaaaataaataataagccttaacttgaacagttgagctgttcataaaactgccctcccatcactgaactagactgcagctccatgtaaatggcagtttccttctcccaattaaatgtgcattcctgggctgggcacagggtacaaaataaagagatagttaaaaaataaaaagcccaaagttgctctggaaaataagcatatgatttgtgaagcagtatgtacatcagtgtggctggatcatcaccaagtagtgtggctataaatggcaatcaggggcaaagtgctcacacctgtgatcccagcactttgcgaggatgaggcaggagtatcacttgagctcaggagttcaagaccagcctcggtaacatagtgagaccctatctctacaaaaaataaaaaaattagcctggcgtagtggtgtgtgcctgtggtcccagctactcaggaggttgaggtgggaggattgcttgagcccgggcggtggagggtacagtgagccaagatcgctccctggcattccagcctgggcgactaagtgagaccctgtctcgaaaataaaataacataaactaaatttgcactttctgcctcaatatttattttgaaaattttcaaatctacagaaattgcaaaaatagtatgataaacccccgtttaacctgcatttagattcatgaagtttttaaactgccacattgcctttcgtgtgtgtgtgtgtgtattttctgaaccatttgaaagttgcatgatcataacccttcaccaaatccttacgtgtccacctcataagagatgctgtccttatctcttgatttgatatacaatgatcaagttcaagaaaattaacattgatatattacccatcatatcaatgataaaaatttcaccaactatccccatgtctttaataacaacctttgtcctaatccatgttctaatccagggtcatgcactgcatttagctgtcattctcttttaatctccctttcaactagaatgattcctaaggctttgccttcatgacactgacatttttgaggtactaacaactacgttttgtagaatttcaatttgggtttttgttttctcacagttagattcaggttatgccttatactcgtcctatcaggaggaccgcaatgtttgtttgttccatggataacgttaactgtgatcacttcattactgtggtaacaggcttctcgactgtatccttcaccctttgtaattaataagcaatctgtaagatgatattttcagactatatgagtcctccgttctccggcaaattttcaagcagggattttggcatccgtttgtaattcttgcctgcatcaatttttacagtgacagtcgcaaacagaaaggaaatttagacattctaaggctgattcttccctactataggattcttttttgagaaatccaaatgtaaaacacacctgtctccgtcacactaattcactttcaaatacttcattttttaaagctatctcatatgtgctttcttacaaccttccttccataaattaaaaatacataaagtaaatgagtagattcactttatgtattatgtgttaacaaagttaacacagaaacaccaattatatttttataaattatcaatgaacaatactgaaaattttttaaaatttacttaaaacagtctcaaaagccataatataattagggataaatattagtttcttagggccaccatagaaaagtaccacaaattgcgtgacttgaaaatacagcaatttattttctcacagttctggctaaaagtccaaaataaatgtgtcagcagggccatgacacttttcaaacttgtaggggatccttccttgcctcttccttgcttctgacagtatgctgataaccttagacgttccttgggttgtaaatacatcactccagtcctccagcctcacgtggtactctgtgtctttacatcatcttccttctgtgcgtgtctgtctctgtgtccaaatttctcctttttataaggaaaccagtcataatggattagggcccattctaatgaccttattttaacttcattactgaaaaaaattgaaggtgacctacacaaacagagaaatatactattttcatggatacaaggactctgttgctgtttggatgtcaattctccccaaattgttctattaagttcaatgcaaccccaatcaaactcctaacaggctgttagtagaaactggtaagttgattgaaaaatttaaataggctgggtgtggcggttcaggcctgtaattccagcacttcaggaggctgagacgggaggactgcttgaggtgagctgttcaagaccagcctgggcagcatagcaaaaccccgtctctacatacaaagaataaatatacggaggacgggcacgatggctcacgcctgtaatcccagcactttggaaggtcgaggcaggagtatcatctgaggtcaagagttcgagaccagcctggccaatgtggtgaaactcccgtctctattaaaaatacaaaaattagccaggcatggtggtacatgcctgtaatcgcagctactcaggaggctgaggaaggagaactgcttgaacctgggaggcagaggatgtagtgagctgagatcacgccactgcactccagcctaggcaacagagcaagactctgtctcaaaaagaaaaaaaaagatttactctaaagtcacagtaatcaagacagtgtgacactaatattagaatcaacggatcaatgaaatagaatagacccacattattttttttaaaaagtcttttcaacaaaaggtacagaaataactgatacccatatgggaaaaagttaacctcaaccccctaacttatacaatattcaaaattaatttgaaatggatcaaagacctaaacataaaagttaaaactggccagacacagtggctcacacctgtaatcctcgcactttgggaggccaaggcaggcggatcacgaggtcaggacttcaagaccagcctggccaacatggtgaagccccatctctacaaaaaatacaaaaattagccaggcatggtggtgcgtgcctgtagtcccagctactcaggaggctgagggaggagaatcgcttgaacctgggaggtggaggttgcagtgagccatcacgccactgcactccagcctgggcgacacaacgaaattcagtctccaaaaaaaaaaggtaaaactataaatcttttagaaaaaaaaatagcaatatcttagcctgaaggtagctaaaggtttcttagaccataaaaagcaataaactataaaaggaaaaatttatgagacttcatgaaaattaagaatttcagctcgtcaaaacaattaagaatatctggcaaagtaccagtattcaaaatacataaataatgtctacaactgaatataaacaatttaggggaaaaagaattaaacagacactttacaatggaagagggcaaaactgtcaataagcacatgaaaaagaacactatcattagttacctggaaattgaaattaaaacaagatactactatcaatacaaatcaactggaatggttaaatctaaaaagacagataacatcaaaagttggtaagatgtacggcaaccagaacctgtatgctgttggtgggattacaaaatgacacaaccactttcgaaaaagatctggtagtttcttctttctttttttgagatggagtctcactctgtcaccgaggctagagtgcagtggcgcgatctaggctcactgcaacctctgcctcctgggttcaagcaattctctgcctcagcctcccgagtggctggtattacaggtgcccgccaccacacccggctaatttttgtatttttagtagatggggtttcagcatcttggccaggctggtcttgaactcctgaccttgtgatccacccgcctcggcctcccaaagtgcgtgagccaccatgcctggcaggtagtttcttataaaaatatgtacctattctacgttgcgtaattccagctcctaagtatttaaccaaaaaaaccctgaaaacataaggccacacatacacacacagagacacaaaaacttgcacaagaaccttctcagcaactttattcataatatccaaaactgcaagcaactgaagcactgtatcagtggagaatggccaatcatatacagcatagtcaatggtggaataatacttaaaaaacgaatatctacacaagaataaatcttgaggccaggcgcggtggctcatgcctgtaatcccagcactttgggaggccgaggcgggtggatcacctgaggtcaggagttcgacaccaggctgggcaacatggtgaaaccccatctctactaaaaatacaaaaattagccaggcatggtggtgcgtgcctgtaatcccagctacttaggaggctgaggcaggagaatcacttgaacccaggagacggaggttgcagtgagccgagatcctgtcactgcattccagactgggtgacagaacaagactgtctcaaaaaaaaaaaaagaataaatcttgaaccttatgctgaataaccccccaaaagatatgcttaagtcctaactcccagtaactaagaatgtggtcttaactggaaacaggttgttacagatataatggagttcatacaaagagtacagagcctttaatccaatataactagtgtcctggtaaaaaaaaaagagagagacacagaggagacggccatgtaaagacagacacaccgggaaactctacgtgccaatggaggcagagactggagtgactcagctgcaaaccaggaacaccatggattccagccacaccagaagctaaggagaagggcacggaacagattctctcccagagccttcaatgtacatgtccctgctccctgctagcatcttgggtttggagttctactcttcagaactgagggagaataaatttctgctaagttcgtggtactttgttacagtagccctaggaaataaaaagaattccatttatatgaagttccagaacagaaaaaactcatctatggtggataaaaactaaaacagcccggacgcggtggctcacgcttgtaatcccagcacttttggaggccaagacaggtggatcacgaggtcaagagattgagaccatcctgaccaacacagcaaaaccccatctctactaacaatacaaaaattagttgggtgtggtgtcgcatgcctgtaatcccagctactcaggaggctgaggcaggagaatgcccacaactcaaaaaaacaacctgattaaatgacaggcaaagttgtggctttttctgggttttgggagaaaaacagaaacaaaaagaatgaatgagcacaggatttgaatagatatttcatatttttccgaagatgatatacaaatggccaataaatgcatgcaaagatgctcgccatccttagtcattggggacatgcaaataaaaaccacaatgggataccacctcatactcaccaggatggctactatcaaaacccagaaaatagcaagtgttggcgagggtgcagagaaactggacacccacgcactgttggtgggaatgtaaaacggtacagtcactgtggaaaacagtatggcggtttccaaaaccaatcacacatagaattaccataggatctagaaattccacttccaggtatacacccaaaagaatagaaaacaggcccctgaacagacatttgtacacccaagttcacaccagcattatttctaatagccgagaagtggaagcaagccaagtgtccactgacagaggaacagatttcttttaatgtagcatatacatacactggaacattattcagcctggaaaagaagggaatgctgtcacatgcagtatggatgaacctggaaaacattacgctaggtaaaacaggccagacacaaaaggacaaaacctatgaaaattccacttacaggaggtacctagaagcagtcgggttcacagaaatggaaaggagaacggtggttgccaggggatagtaggagggaggaacggtgagcctcaagggtgtggaaattcagtttgggaggattaaaaagttctggagatggacggtggtgacggatgcacagcagtgtgaacggaggcgatgccactgaaccatacaattacaaacggttaaaattttcctcccttctttctagtcaaaaacatttttaagtggttaaaatggtaatcttgctatattttaccacaattttttttttttgaaacggagtctcgctctgtctcccaggctggagtgcggtggcgtgatctcggctcactgcaagctccgcctcccgggttcacgccattctccggcctcagcctcccgagtagctgggactacaggcgcgtgccaacatgcccggctaattttttgtatttttagtagagagggggtttcaccgtgttagccaggatggtctcgatctcctgacctcgtgatccgcccgcctcggcctcccaaagtgctgggattacaggcgtgagccgccgcgcccggccccgcaattttttgacacacagagttaagataccagttcacatgtactagcatggcacggaaaataacaagtgttggtgaggaagtgaagaaactggaaacttcgtactctgctaatggaaatgtaaaatggtacagccactgtagaaatcaatgtggcagttcctcaaaaagctaaacacagaattaccataggatccagcaattccactcgtagatatatagacaaaagaactgaacacaggtattcaaacacatactggtacataaatgttcgtatcgccagtattcaaataacgaaaaggtgaaaaaaaccaatgtccagccaatggataaacaaaatgtaacaagtatatccgtaaaacaaattattattcagcccgaaaaatgaagtactgatccatgccacactgtacatgaacctcagaaacacgctaagtgaaataagctagacacacaagatcctatattgcatgagtcccttctatgaaatacctagaatggccagattcatagagacagaaagtggaatagaaggtgccgaggctggggggaaaggtgaaatggggagtcagtgcctcacggttagagtttatctggggtgatgaaaagttctggaaacagtggtgatggttacattgtgaatgtaattaatgctattgaattgtacttaaaaatggttaaaatgtcagtttgttatatacattttggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagc

SEQ ID NO: 1961 - DNA, 13212 bp, Homo sapiens
aagccccgcccgttcctccgaaattgggtcgcagtcccaccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggaggtgaggcccggccccgcttggaagggggacaccagggcctgaggcccaggccacgctcacacctctctgctctccttgctcccagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggtgaatcccctggccttatgggagagggggctggggtttggctagaaaaggcctgaggttgtgctgaatgggaaggggtccagccctactaggcaggaaacctcctgggtggtgactcgtttgaatgtgtggcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcaggtgagatgctcctctagtcttgatggacttatgcaccagggctggggagcccagcctaactcaagtaagtttgaggacccccgtgctgctgaactatgggcatagttcagcattctgggagctccgggtactgattttccttctgtgaatgttaagggaccagggcttagagggagggctttgttctaggggtctagctggaaaccgtttttatctgtattattgcagaatactcatccaagacagcaggcactggagcagctgttggaagacaaggttgaagatgatgtaaggaaggcaggaaaggggctggtgtacaaaggaaacaggaattgtgagactctgtgtccctaaacccttattcattccctgccctttctttttcagatgctgcagctttcagaatttgaccccctattgagagagattgctcctggccccctcaccacaccctctgtcccaggtattattggtcctaaattggggaccaggtaggaagctatattgatggaaatttgggatgctcctctgtcttcttggttatcttcctttgtgtttgtttgttttgagacggagttttgctcttgttgcccaggctggagtgcaatggtgcgatctccgctcaccgcaacctccacctcccgggttcaagcgattctcctgcctcagcctcccgagtagctgggattacaggcatgcgccaccgcgctcggctaattttgtatttttggtagagatggggtttctccatgttggtcaggctggtctggaactcctgacctcaagtgatccacccacctcagcctcccaaagtgctaagattacctgcatgagccaccacgcccggcctctttgttttttaaaagagattaaaattgtttccttgggtccagatgtttaaaaagtagtcttgtgatttgcccccatccacagcagattcagatgtagcctggtcttttttggaaagatgttccatctctcctgccctccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccaggtgagagggcttctcttctgggtgggagtgaaatttagagaacttaagatcacttgattatggactacctgccagtttctgtgctaaagactgtttaatagaggacaagtagccagtcagaaccctgaaagagataatagacatacacatcaagcaggtagcaattgcagtaacccaggttgttatggtaataggtggtttgcaacctagtctgaagggtcagctgaatcaggtggcaatattttaaacacctagtgtaggtcaggccatgtgttagcagtatctactaggaagaagtgagctttaagctgtcatttaaatgttgcataagctatgggtataggagtattcgagacagacaatgtgtgcaaaggccagtgacatgagttgttacccaggaaatggagaatgcttagaggtgagggatccaggcaccaggtgccacttcagcaggccatgtctgcttttccattacagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcaggtaactggccttcccagctctttatcgtgtgttacctcaggcattctcttccctatcccatgttttccttcagttcctcccaactccctgtatttctgttgtgaacttcagccagccagtcaaagggataattctctctgccttcccagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggtaaggactgggcctgcgatgaggtagggctgagctggtctgggaaaggagatgctgcaggtggttaatagtttctatgaatcttgttattgttagcagcagctgcctgttactgaggcagttaccattgctgtacactgatgacatgatccatatgtctgagctgagccactgtcaccatcttagttcaggctgagggtgggtgaagggtgcccctcctgatgggcgggactgtgccttaggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtatcagctgtgctggatatgggatagggtcgagagtctgcatctctcacactctcccttgcttgctttcccacttcattcccccttgccactcccatcttgcaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcaggtgctgggaggaggcaagaagcccaagggtccacctagaggagcaagagggagctgaggggaagggtccctggagtctgacagcacttcccccctccacctgaatcatattgcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccgggtaagtccctccccacgatacctggtccaagaattactctattcttttggacccccatcctaccccagtctccatctctgatcctgtcttctgctcttcagttgcccatatacccctgaaggctcctgggagggggaagtcaggaacaggcttatctcctcccttttaaaacaatgttctattatggaaattttcaaacatgcaatagtagaaaaattgtactacactgtataacaaattcccatacccccctgcaacccctccacttccagtgtatttgtcatcaagcttcagcaattgtcaacaaacatgatcagtctttatttcacatatatacacagatggctattatgatatcaaatatcaggcataatatagtttataaatgtttccgtatatatctctaaaatgtaaaactttatttatttatttacttatttattttttttagatggaatttcacccttgcccccaggctggagtgcaatggcgtgatctcggctcactgtaacctctgcctcctccaagcaattctcctgcctcagcctcctgagtagctgggattacaggcacccgccaccacactcggctaatttttgtatttttagtagagacagggtttcgccatattggccaggctggtctcgagctcttgacctctacaattattttaaatacagagtaaaaccaaaataaaacacatacagagccagtctaactactctgacctagagtacgtggagtctcaggaactaagaagggcttattcctataaactggatatttgctgatattaaagaattaccaggctgggcgcggtggctcacgcctctaatgccagcactttgggaggccaaggcaggccgatcatgaggtcaggagatcgagaccatcctggctgacgcagtgaaaccctgtctgtactaaaaatgtaaaaaattagccaggtgtggtggcaggcgcctgtagtcccagctactcaggaggctgaggcaggagaatggcgtgaactcaggaggcggagcttgcagtgagccgagatcgcgccactgcactccagcctgggcaacagcgcaagactccgtcttaaaaaaaaaaaaaaagaattactgttcatttttgtgtgtgtgtgtgacagtgctactgtggctatgttttcaaaaagaattttgctgggcatgatgcctcatgcctgtaatcctagagctttgggaggctgaggtgggagaataccttgaagccaggagttagagaccagcatgggcaacataacaagactcccatctctaaaaaaataaataaaggtccgggcatggtggctcacgcctgtcatccctgcactttgggaggccaacgtgggtggatcacgaggtcaagagattgagaccatcctggtcgacatggtgaaaccccgtctctactaaaaatacaaaaattagccaggcgtggtggcgtgcacctgtaatcccagctactcgagaggctaaggcaggagaatcgcttgaacctgggaggtggaggttgcagtgagccaagatcgtgccaccgcactccagcctgggcgacagaatgagattccgtctcaaaaaaaaaacttaaattaaaaaaaataataaaatacataaagttggccaggcgcagtggctcatacctgtaatcctagcactttgggaggctgaggtgggtggatcacctgaggtcaggagttcgagaccagcctgaccaacatggtgaaaccctgtctctacaaaaaatacaaaaattagccgggtgtggtagtgggtgcctgtaatcccagctacttgggaggctgaggcaggaaaatctcttgaacctgggagacagaggttgcagtgagccaggattgcgccacagcactccagtctgagcgacagagtgagactctgtctcaaaataaattaaataaataaataaatgtagaatctacaggaagtttcaaaaatagtgcatagagtcctgtgtacttttcactaaccttcactcagcgatgacatttttttgagacggagtctcgctctgtcgccctggctggagcgcagtcgcgcaatcatggctcactgcaacctctgcctcccggttcaagcgattctcctgtcccagcctcccaagtagctgtgattacaggcatctgcaatcatgcccggctaatttttttttttttgagacagagttttgctcttgttgcccagcctggagtgcaatggtgcgatctcggctcactgcagcctccgcctcccgagttcaagtgattctcctgcctcagcctcccgagtagctgggattacaggcatgcgccaccacacttggctaattttgtatttttagtagagacgggtcaggctggtctggaactccagatctcaggtgatccgcctgcctcagcctcccaaagtgctgggattacaggcataagccatggtgcctggcctaatttttgtatttttagtagagacaaggtttcacaatgttggccaggctggtctcgaactcctagcctcaagtgatgcgcccgccttggcttcccaaagtactgggattacaggtgtgagccagcgtgcccggcccccagtggtgacttcttatatagttatagtacaatatcaagaccaagaaataagacattgctccaatgttagctatactacaggtcttgttcatttttctcatggatatgccgctgtgtgtatgtgtggttctatgcagttctgtcccacgtatggatgcatataaccaccaccataatcaagatacagattgtttcatcaccacaaaggaactctctcatgtacctctttagttatacccttctgcccccacttctagtcacctggcaaccatgaagctgttctccacctctatagttttgtcatttcaagcatgttatttgtatatttaatggaatatgaatgtttttataggcacttttgcctttaccttaggtgtcaccattgtctattttcctccacccgactgtcttcagatgtttacgttgcctgcctggcccctgctggcacttgaggttgttaaccctgcccagttgttaattagaccctgatttcttagtggacacctggccactgcctcttccctagcctggcagctgtggcttctgaccccctcccctccaacccctcaccctccagatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccaggtactgcagcccctctaggactcaggtaccctgagctttgaacagggaccctcccacccaccacctctgcatcctgtccccagcttcgcgagagcctagagccagatgcctatgcgttgttccataagaagctgaccgagggtgtgctgatgcgggaccccaagttcttgtggtgtgcccaggtaagtggcctgcccagggcagctactgtggaggggcaggggatggttccaggtcaggcctttgataactttatgctcttgcacttccagtgctcctttggcttcatatatgagcgtgagcagctggaggcaacttgtccccagtgtcaccagaccttctgtgtgcgctgcaagcgccaggtgaggcacattcatcctttcagaaatacttgctgagctactgccaggtactgtgttagactcaggggagtttgtgtactggagagcaaaacagacatgagctctgaggtcaaaagagcttacagactactcagaaagactaggcacaaggagaaagggaagcagagggagggaggaaatcgggagggaaaggaaaggggaggaggaaggaaggaaggaaagaaagtaagccagaggaactaattatacataggcataaattctatgaagaaaacaaacaggaacctgagatcagggtaacagagtggacctacttagggtagagaggtcagacaagtcttctctaaaatggtttaagctcaggcctaaacattaaaaagaagccagccatgcaaagagcatttgggagagaaagaacaacacatggaaaggccagaatcagaaaaaagtgttgtatggctggagcctggaaagcaaggcgggaatggcaggtggtcagagagaagccagctgccaggtctgtagagccctggaggccacgtgaagcaggcgtccgtctgccttcattctgagataaagcaagggtgatactatctcatttatctttcgtttatttatttatttatttatttttagagacaactcactgtcacccaggctggggtccactggtgcagtcacagctcactgcagcctccaactcctggtctcaagtgatccctcgcctcagccttccaaagtactgggattacaggcatgagccactatgcccagccacatttatcttttaagaagtgtaatatttggctaggcatggtggcttccgcctgtaatcccagcactttgggaggccatggtgggtggatcacttgaggttgggagttcaagaccagcctcccaatatggtgaaaccccgtctctactaaaaatacaaaaattagccgggtgtggtggcatgtgcctgtaatcccaactactctggaggctgaggcaggagaatcgcttgaacccaggaggtggaggctgcagtgagccaagatcacgccattgcactccagcctgggtgacagagcgagactccatctcaaaaaaaaaaaaagaagtgtaatatttgatacgaaaaaaatttcatctgcatcatgtctgaaataaagtgaacacctgagactaccacagaaccaaaacaccaccaatcctgtggaagctacctgacttacagttttgaaggacttttgacagccatggggagaattgaccctaggggagcaggaatgggaaacagagagactagtaaccgaggcaagcaattgaggcaaggtctgatggtggcctggagtaaagtggtagcagtagggatgaaggaaaaggggatatggttgagatggtctgtggggtggaaacaaggcaaaagtagtgtgaggtggtaggagaaaatgaaaggaccaaggatggcctctcattttgagatctgagcaaatggtaggtggcagtgacataaaccaagctggggaaccactggatgtgagtggaggggccagcaagaaaggccaggggatgggatagagctcccatgtgaagcctactttccctctggcagtgggaggagcagcaccgaggtcggagctgtgaggacttccagaactggaaacgcatgaacgacccagaataccaggcccagggcctagcaatgtatcttcaggaaaacggcattggtaaggcctccctactcggcctgtttgctcagaagcctgtcattgccagcagctctcttcctgagggccttgagttgcagcggcagctccagccctgacctcttgtcctttgcagactgccccaaatgcaagttctcgtacgccctggcccgaggaggctgcatgcactttcactgtacccagtgccgccaccagttctgcagcggctgctacaatgccttttacgccaagaatgtaagcccagagagttggggaaggggtggaagggtggggggtgccattggctttgagagtcagaggctattgaggagtggccccggggaagagaagaggtcaacgggatgtaaagcacaactctctgtccccttaccctttgcttgctcctccaatgtctccatctcccctcacccttacacccctcacgcaggggttcctgagaggccaggaccccaacagtctccaacttcctctctcccatctgggtttctgccagaaatgtccagagcctaactgcagggtgaaaaagtccctgcacggccaccaccctcgagactgcctcttctacctgcgggactggactgctctccggcttcagaagctgctacaggtcagaggtggccaggagagaagaagacagggcccagggtgggcaagaatggaaaaggctccgtgctaggaattgcaacagggacttggcatcaaggggaatgtaacacccatctgtctctcctcctcaggacaataacgtcatgtttaatacagagcctccagctggggcccgggcagtccctggaggtgagtgttaggacaagcctttgagaagaggagatggtgtgctgggctcccaccgtgtgatgggtaaaggggaggcttgggtctggggtcacttgttgcatgccctttggcaagttaattgagacccaaggccttgtttcttccgctgtaaaatggaggtagtatccaccttgcagctaagccattttacataagacatctttaaagaacctggtacccaagaaggcattaatactaattttcttctcccattcccaaatgatcataattaattaattagttcaatgagtgtttaatgagaagtgctagttgcagggcactgttttaggttccatgagggcaacagaaaggtgttacatatggttctaacctctgtcacttcttacagtgtagacagaggtaagtctacagtccataccaccctgaatgtgactgatcttttctgatcttggaggctaagcaggttcgggcctggttagtacttggatgagagattggctgggaattccaggtgctataggttttaaatttattttttaaaaaatagaggtggccggccgggcacattggctcatgcctgtaatcccagcactttgggaagccaaggcgggtgaatcacgaagtcagatcgagaccatcctggctaacacggtgaaaccccatctctactaaaaatacaaaaaattagccgggcgtggtggcgggcgcctgtagtcccagctactcgggaggctgaggcaggagaatggcatgaacccgggaggcggagcttgcagtgagcagagatggcgccaccgcactccagcctgggcaacagagcgagacttcgtctcaaaaaaaaaaaaaaaaaaaaaaaaaaatgtggctgggcacggtggctcatgcctgtaatctcagcactttgggaggccgaggcaggtggatcacctgacgtcaggagttcgtgaccaacctggccaacaaggtgaaaccctgtctctactaaaaatacaaaaaaattagcaaggtgtggtggcaggcacctgtaatcccacctactcgggtggctgaggcaggagaatcacttgaacccgggaggtggagattgcagtgagccaagattgcgccattgcactccagtccagcctgggcaacaagagtgaaactccatctcaaaaaaaaaaaaaaaaaaaaccagaggtagccaatagccaggagtggtggtggctcacacccataatcccagcactttgggaggctaaggcaagaggattacttgagcccaggagtttgagaccagcccaaacaacatagtgagaccctgtctctatttaaaaaataaaaataaaaaaaagaggtaagatcttccgataataagttaactagtcaagagataaataacaaccaaaaaaaaaaaaaaaaaaaaaacactatctcaagagggtatgtgtttatgagccaaaagccagcttggataaaagtagggacaaggtccctgcctctgtatcagatggtctgccgttgacggcacctctgagtacccaccagcaccactgggaaagcaggagttgctgtgctcggtcccttccttggaggctgccttccctgccttgtggatatcccagttctggagctttgtggtcattggcctcccaacagaggctcccttcttccctcacctttaggcggctgccgagtgatagagcagaaggaggttcccaatgggctcagggacgaagcttgtggcaaggaaactccagctggctatgccggcctgtgccagtgagtgccagcaggacatgggcatggtgttgggcagtgggtagaagtggtgagggcatgcccaggcagtaaaatgggtccttgggagcagtaggtcttgcagtgggtgggagggaggaggctttctgggcaagggcatgggtagatagtagcaggcagtgtgggcacaggtgggttgttaatcttgttcgtccaggtgtctcagagtccagctatgttagacacactcagttaatattagccaacacaacaaatattctgctcccttttctccccagggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacaggtatagcctccacccagcctcatctcttaacccaccctacagaagtcacctggtgctgactgtgtctgagctccaggcttccaatatcattaccttctctctccttctgcagaagctgacagaagaggtacccttgggacagagtatcccccgcaggcggaagtagctgagggcaagggtcccgatgagggtcccatggcctgctccctcaggaacagctccagcaccaataaagaggcatcttaccacccagg

SEQ ID NO: 1962 - DNA, 130 bp, Homo sapiens
aaccatccttttcttggggttgcgctactgtccaatgagcgcatagtgagggcagtactgctaacgcctgaacaacacacccgcatcaactagagcttttgctttattttggtgcaatttttggaaaaat
